(12) United States Patent
Mootha et al.

(10) Patent No.: US 11,866,736 B2
(45) Date of Patent: Jan. 9, 2024

(54) PROTEIN PROSTHESES FOR MITOCHONDRIAL DISEASES OR CONDITIONS

(71) Applicant: The General Hospital Corporation, Boston, MA (US)

(72) Inventors: Vamsi Mootha, Boston, MA (US); Denis Titov, Boston, MA (US); Valentin Cracan, Boston, MA (US); Zenon Grabarek, Boston, MA (US)

(73) Assignee: The General Hospital Corporation, Boston, MA (US)

( * ) Notice: Subject to any disclaimer, the term of this patent is extended or adjusted under 35 U.S.C. 154(b) by 776 days.

(21) Appl. No.: 15/749,218

(22) PCT Filed: Aug. 1, 2016

(86) PCT No.: PCT/US2016/045015
§ 371 (c)(1),
(2) Date: Jan. 31, 2018

(87) PCT Pub. No.: WO2017/023855
PCT Pub. Date: Feb. 9, 2017

(65) Prior Publication Data
US 2019/0017034 A1 Jan. 17, 2019

Related U.S. Application Data

(60) Provisional application No. 62/199,695, filed on Jul. 31, 2015.

(51) Int. Cl.
| | |
|---|---|
| *C12N 9/02* | (2006.01) |
| *C12N 5/10* | (2006.01) |
| *C07K 14/335* | (2006.01) |
| *C07K 14/195* | (2006.01) |
| *C12N 5/071* | (2010.01) |
| *C12N 15/52* | (2006.01) |
| *C12N 15/85* | (2006.01) |
| *A61K 47/66* | (2017.01) |
| *A61P 25/16* | (2006.01) |
| *A61K 9/127* | (2006.01) |
| *A61K 38/16* | (2006.01) |
| *A61K 38/17* | (2006.01) |
| *A61K 47/18* | (2017.01) |
| *A61K 47/42* | (2017.01) |
| *C12N 15/113* | (2010.01) |
| *C12N 15/62* | (2006.01) |

(52) U.S. Cl.
CPC .......... *C12N 9/0036* (2013.01); *C07K 14/195* (2013.01); *C07K 14/335* (2013.01); *C12N 5/0602* (2013.01); *C12N 5/10* (2013.01); *C12N 15/52* (2013.01); *C12N 15/85* (2013.01); *C12Y 106/03001* (2013.01); *A61K 9/127* (2013.01); *A61K 38/162* (2013.01); *A61K 38/1709* (2013.01); *A61K 38/1774* (2013.01); *A61K 47/18* (2013.01); *A61K 47/42* (2013.01); *A61K 47/66* (2017.08); *A61P 25/16* (2018.01); *C07K 2319/07* (2013.01); *C07K 2319/43* (2013.01); *C12N 15/113* (2013.01); *C12N 15/62* (2013.01)

(58) Field of Classification Search
CPC ...... C12N 9/0036; C12N 5/0602; C12N 5/10; C12N 5/85; C07K 14/195; C07K 14/335; C07K 2319/07; C12Y 106/03001
USPC ................................ 435/325, 69.7, 455, 189
See application file for complete search history.

(56) References Cited

U.S. PATENT DOCUMENTS

| | | |
|---|---|---|
| 8,669,074 B2 | 3/2014 | Violin et al. |
| 2002/0032323 A1* | 3/2002 | Kunsch ................ C07K 14/315 536/23.7 |
| 2010/0022628 A1 | 1/2010 | Rustin et al. |
| 2011/0171218 A1 | 7/2011 | Seehra et al. |
| 2011/0311506 A1 | 12/2011 | Craig |
| 2013/0030164 A1 | 1/2013 | Yoshida et al. |

OTHER PUBLICATIONS

Petschacher et al. (2014) Computational and Structural Biotechnology Journal, vol. 9(14),e201402005, https://doi.org/10.5936/csbj.201402005, pp. 1-11.*
Lountos et al. (2006) Biochemistry, vol. 45, 9648-9659.*
Pagliarini et al., "A mitochondrial protein compendium elucidates complex I disease biology," Cell. 134(1):112-123 (2008).
Fassone et al., "FOXRED1, encoding a FAD-dependent oxidoreductase complex-I specific molecular chaperone, is mutated in infantile-onset mitochondrial encephalopathy," Hum Mol Genet. 19(24):1-43 (2010).
Calvo et al., "High-throughput, pooled sequencing identifies mutations in NUBPL and FOXRED1 in human complex I deficiency," available in PMC Apr. 1, 2011, published in final edited form as: Nat Genet 42(10): 851-858 (2010) (22 pages).
Sugiana et al., "Mutation of C20orf7 disrupts complex I assembly and causes lethal neonatal mitochondrial disease," Am J of Hum Genet. 83(4): 468-478 (2008).
Lieber et al., "Next generation sequencing with copy number variant detection expands the phenotypic spectrum of HSD17B4-deficiency," BMC Med Genet. 15:30 (2014) (6 pages).

(Continued)

*Primary Examiner* — Anne Marie S Wehbe
(74) *Attorney, Agent, or Firm* — Clark & Elbing LLP

(57) ABSTRACT

The invention encompasses water-forming NADH and NADPH oxidases and the use of these enzymes to treat mammalian diseases or conditions associated with an elevated NADH/NAD+ ratio or NADPH/NADP+ ratio. Such pathologies include disorders caused by one or more defects in the mitochondrial respiratory chain, glucose metabolism disorders, cancers associated with reductive stress, and aging. The invention also provides a research tool for investigating the effect of exogenous water-forming NADH or NADPH oxidases on the metabolism of a mammalian cell, such as a human cell, and for elucidating the role of respiratory chain proteins in mitochondrial disorders.

5 Claims, 50 Drawing Sheets

Specification includes a Sequence Listing.

(56) References Cited

OTHER PUBLICATIONS

Quinzii et al., "Coenzyme Q deficiency and cerebellar ataxia associated with an aprataxin mutation," Neurology. 64(3): 539-541 (2005) (5 pages).
Vafai et al., "Mitochondrial disorders as windows into an ancient organelle," Nature. 491(7424): 374-83 (2012).
Nilsson et al., "Metabolic enzyme expression highlights a key role for MTHFD2 and the mitochondrial folate pathway in cancer," available in PMC Jul. 22, 2014, published in final edited form as: Nat Commun. 5:3128 (2014) (23 pages).
Kovács-Bogdán et al., "Reconstitution of the mitochondrial calcium uniporter in yeast," Proc Natl Acad Sci U S A. 111(24): 8985-8990 (2014).
Mootha et al., "Erralpha and Gabpa/b specify PGC-1alpha dependent oxidative phosphorylation gene expression that is altered in diabetic muscle," Proc Natl Acad Sci U S A. 101(17): 6570-6575 (2004).
Sinha et al., "Biochemical characterization of pathogenic mutations in human mitochondrial methionyl-tRNA formyltransferase," J Biol Chem. 289(47):1-29 (2014).
Balaban et al., "Spectroscopic determination of cytochrome c oxidase content in tissues containing myoglobin or hemoglobin," Anal Biochem. 237(2): 274-278 (1996).
Puigserver et al., "Cytokine stimulation of energy expenditure through p38 MAP kinase activation of PPAR gamma coactivator-1," Mol Cell. 8(5): 971-982 (2001).
Rhee et al., "Proteomic mapping of mitochondria in living cells via spatially-restricted enzymatic tagging," available in PMC in Feb. 7, 2014, published in final edited form as: Science 339(6125): 1328-1331 (2013) (8 pages).
Mootha et al., "Neutral carrier-based "Ca(2+)-selective" microelectrodes for measurement of tetraphenylphosphonium," Anal Biochem. 236(2): 327-330 (1996).
Mootha et al., "Maximum oxidative phosphorylation capacity of the mammalian heart," Am J Physiol. 272(2 Pt 2) H769-H775 (1997).
Mootha et al., "Integrated analysis of protein composition, tissue diversity, and gene regulation in mouse mitochondria," Cell. 115(5): 629-640 (2003).
Mootha et al., "Identification of a gene causing human cytochrome c oxidase deficiency by integrative genomics," Proc Natl Acad Sci U S A. 100(2): 605-610 (2003).
Mootha et al., "PGC-1alpha responsive genes involved in oxidative phosphorylation are coodinately downregulated in human diabetes," Nature Genet. 34(3): 267-273 (2003).
Calvo et al., "The mitochondrial proteome and human disease," Annu Rev Genomics Hum Genet. 11:25-44 (2010) (22 pages).
Zhang et al., "Assessment of uncoupling activity of uncoupling protein 3 using a yeast heterologous expression system," FEBS Lett. 449(2-3): 129-134 (1999).
Wu et al., "Mechanisms controlling mitochondrial biogenesis and respiration through the thermogenic coactivator PGC-1" Cell. 98(1): 115-124 (1999).
Cracan et al., "A genetically encoded tool for manipulation of $NADP^+$/NADPH in living cells," Nature Chemical Biology 13(10): 1088-1095 and 3 supplemental pages (11 pages) (Aug. 2017).
International Search Report and Written Opinion for International Application No. PCT/US16/45015, dated Dec. 15, 2016 (22 pages).

* cited by examiner

PROTEIN PROSTHESES FOR MITOCHONDRIAL DISEASES OR CONDITIONS

STATEMENT AS TO FEDERALLY FUNDED RESEARCH

This invention was made with government support under grant GM099683 awarded by the National Institutes of Health. The government has certain rights in this invention.

FIELD OF THE INVENTION

The invention relates to the fields of enzyme therapy and gene therapy for the treatment of diseases and conditions associated with mitochondrial dysfunction. The invention further relates to the field of mitochondrial metabolism for the analysis of defects in mitochondrial proteins that contribute to the onset of human pathology.

BACKGROUND OF THE INVENTION

The mitochondrial respiratory chain constitutes a vital component of a healthy eukaryotic cell, as the ensemble of proteins and redox-active molecules that comprise this complex is chiefly responsible for energy production and drives aerobic cellular respiration. Defects in the activity of one or more proteins within the respiratory chain, as well as in proteins that are responsible for the assembly, maintenance, or turnover of the respiratory chain, are associated with a variety of human diseases, including rare genetic syndromes and common diseases, such as neurodegeneration, cancer, and diabetes, as well as the aging process itself. Disorders associated with respiratory chain dysfunction are considered to arise from inefficient mitochondrial adenosine triphosphate (ATP) synthesis. As such, the development of therapeutic proteins for mitochondrial diseases has focused on replacing the activity of individual complexes of the respiratory chain so as to preserve the mitochondrial production of ATP. For instance, recent attempts at treating deficiencies in complex I of the respiratory chain involve the use of the yeast NADH dehydrogenase NDI1 (see US 2011/0197294). Other investigations attempt to treat defects in complexes III and/or IV using an alternative oxidase (AOX; see U.S. Pat. No. 7,572,616). These approaches attempt to treat mitochondrial disorders by replacing defective components of the respiratory chain with supplemental oxidoreductases in order to maintain the chemiosmotic gradient that drives mitochondrial ATP production.

The use of these therapeutic approaches to treating mitochondrial disorders is limited to patients harboring mutations in particular complexes of the respiratory chain. The challenges associated with treating diseases arising from defective respiratory chain activity generally stem from the need to identify the individual mitochondrial protein in a specific patient that is defective and to design a treatment that targets this particular complex. This approach is particularly challenging in patients having deficiency of multiple or all complexes of the respiratory chain. There is currently a need for improved therapies for mitochondrial disorders.

SUMMARY OF THE INVENTION

The invention features water-forming NADH and NADPH oxidases as protein prostheses for treating mitochondrial diseases and disorders, as well as water-forming NADH and NADPH oxidases as research tools for investigating the effects of NADH and NADPH oxidation with concomitant reduction of molecular oxygen on cells, such as mammalian cells (e.g., human cells).

Embodiments of the invention include a mammalian cell containing a water-forming NADH oxidase. The mammalian cell may include a polynucleotide encoding the water-forming NADH oxidase, which may optionally be under the control of a mammalian promoter. The polynucleotide may be codon-optimized for expression in a mammalian cell. The polynucleotide may be integrated into the nuclear or mitochondrial genome of a mammalian cell (e.g., a human cell). In particular, the NADH oxidase is not endogenous to the mammalian cell. The water-forming NADH oxidase may have a polypeptide sequence having at least 85%, 90%, 95%, 97%, 99%, or 100% sequence identity to the sequence of any one of SEQ ID NOs: 1-273.

The water-forming NADH oxidase may exhibit various biochemical properties. For instance, a water-forming NADH oxidase may:

a) exhibit Km values for NADH and $O_2$ of no more than about 100 µM and 20 µM, respectively; and/or
b) be capable of producing less than about 10% by mole of $H_2O_2$ compared to $H_2O$ production during the catalytic cycle of the oxidase; and/or
c) produce less than about 2% by mole of $H_2O_2$ compared to $H_2O$ production during the catalytic cycle of the oxidase; and/or
d) be capable of selectively oxidizing NADH over NADPH (e.g., exhibits a $k_{cat}/K_M$ for NADH that is increased by 10-fold, 20-fold, 30-fold, 40-fold, 50-fold, 60-fold, 70-fold, 80-fold, 90-fold, 100-fold, 200-fold, 300-fold, 400-fold, 500-fold, 600-fold, 700-fold, 800-fold, 900-fold, 1,000-fold, 1,100-fold, 1,200-fold, 1,300-fold, 1,400-fold, 1,500-fold, 1,600-fold, 1,700-fold, 1,800-fold, 1,900-fold, 2,000-fold, 3,000-fold, 4,000-fold, 5,000-fold, 10,000-fold, or more, relative to the $k_{cat}/K_M$ exhibited for NADPH); and/or
e) be capable of binding flavin adenine dinucleotide (FAD) when the NADH oxidase is in a catalytically active state; and/or
f) be capable of selectively reducing the secreted or cytosolic ratio of lactate to pyruvate; and/or
g) be capable of increasing oxygen consumption by a mammalian cell (e.g., a human cell, for instance, by 1.1-fold to 10-fold (e.g., 1.1-fold, 1.2-fold, 1.3-fold, 1.4-fold, 1.5-fold, 1.6-fold, 1.7-fold, 1.8-fold, 1.9-fold, 2.0-fold, 2.1-fold, 2.2-fold, 2.3-fold, 2.4-fold, 2.5-fold, 2.6-fold, 2.7-fold, 2.8-fold, 2.9-fold, 3.0-fold, 3.5-fold, 4.0-fold, 4.5-fold, 5.0-fold, 5.5-fold, 6.0-fold, 7.0-fold, 8.0-fold, 9.0-fold, or 10.0-fold, or more) without increasing the rate of adenosine triphosphate (ATP) synthesis; and/or
h) be capable of increasing the rate of glucose production by gluconeogenesis; and/or
i) be capable of increasing the rate of proliferation of a mammalian cell in which there is a defect in the replication of mitochondrial DNA; and/or
j) be capable of increasing the rate of proliferation of a mammalian cell in which there is a defect in the translation of mitochondrial proteins.
k) be capable of increasing the rate of proliferation of a mammalian cell in which there is a defect in the activity of mitochondrial respiration.

The invention also features a water-forming NADH oxidase that may be prepared as a fusion protein. The fusion protein may contain the NADH oxidase and an additional molecule, which may be an antibody Fc region, a cell-penetrating peptide (such as a peptide having the sequence of any one of SEQ ID NOs: 279-297), a molecule that increases the serum half-life of the fusion protein, a molecule that increases the solubility of the NADH oxidase, or a targeting molecule (such as a polypeptide, a saccharide, a lipid, or a small molecule) that selectively localizes to a particular organelle (e.g., the mitochondria) within the cell. The targeting molecule may be the mitochondrial targeting sequence of subunit IV of human cytochrome c oxidase.

The invention also features a polynucleotide encoding a water-forming NADH oxidase, such that the gene is under the control of a mammalian promoter and/or also includes a nucleic acid sequence that encodes a cell-penetrating peptide or a peptide that localizes to a particular organelle within a mammalian cell (e.g., a human cell). The polynucleotide may be codon-optimized for expression in a mammalian cell. The polynucleotide may be part of a transposable element, which may optionally contain a transposase recognition and/or cleavage element that may promote incorporation into a deoxyribonucleic acid (DNA) molecule of a mammalian cell, such as nuclear or mitochondrial DNA. The water-forming NADH oxidase encoded by a polynucleotide of the invention may have at least 85%, 90%, 95%, 97%, 99%, or 100% sequence identity to the sequence of any one of SEQ ID NOs: 1-273, and may optionally have any of the biochemical properties described above. The NADH oxidase encoded by a polynucleotide of the invention may also be a fusion protein as described above, such that the components of the fusion protein are proteinogenic.

The invention also features a vector containing a polynucleotide that encodes a water-forming NADH oxidase. The vector may be an expression vector, such as a eukaryotic expression vector, or a viral vector, such as an adenovirus (e.g., a serotype 5, 26, 35, or 48 adenovirus), retrovirus (e.g., a γ-retrovirus or a lentivirus), poxvirus, adeno-associated virus, baculovirus, herpes simplex virus, and a vaccinia virus (e.g., modified vaccinia Ankara (MVA)). The NADH oxidase encoded by the polynucleotide may be a fusion protein, such as those described above and herein.

The invention also features a polypeptide containing a water-forming NADH oxidase and an additional molecule at the N- or C-terminus of the polypeptide, optionally tethered by a linker. The linker may be a peptide containing one or more amino acids, including D- or L-amino acids and/or non-naturally occurring amino acids. Alternatively, the linker may be a non-peptidic molecule. In particular embodiments, the linker may be cleavable, for example, by a process such as enzymatic hydrolysis, photolysis, hydrolysis under acidic conditions, hydrolysis under basic conditions, oxidation, disulfide reduction, nucleophilic cleavage, and organometallic cleavage. The NADH oxidase may have any of the biochemical properties or sequence characteristics described above. The NADH oxidase may be capable of selectively increasing the total ratio of $NAD^+$ to NADH in an organelle without significantly altering the ratio in a different organelle, and/or may be capable of inducing the dephosphorylation of pyruvate dehydrogenase complex (PDH). The additional molecule may be an antibody Fc region, a cell-penetrating peptide (e.g., as described above), a molecule that increases the serum half-life of the polypeptide, a molecule that increases the solubility of the NADH oxidase, or a targeting molecule that selectively localizes the polypeptide to a particular organelle within a mammalian cell (such as one that localizes to the mitochondria, nucleus, golgi, endoplasmic reticulum, lysosome, peroxisome, or adiposome, e.g., a peptide containing subunit IV of human cytochrome c oxidase that is directed to the mitochondria). The polypeptide may contain a first molecule that is capable of being selectively bound by a second molecule. For instance, the first molecule may be an epitope tag, such as maltose-binding protein, glutathione-S-transferase, a poly-histidine tag, a FLAG-tag, a myc-tag, human influenza hemagglutinin (HA) tag, biotin, or streptavidin. The second molecule may be maltose, glutathione, a nickel-containing complex, an anti-FLAG antibody, an anti-myc antibody, an anti-HA antibody, biotin, or streptavidin. The polypeptide may optionally contain a fluorescent molecule, such as green fluorescent protein, cyan fluorescent protein, yellow fluorescent protein, red fluorescent protein, phycoerythrin, allophycocyanin, hoescht, 4',6-diamidino-2-phenylindole (DAPI), propidium iodide, fluorescein, coumarin, rhodamine, tetramethylrhoadmine, and cyanine.

Additional embodiments of the invention include a mammalian cell containing a water-forming NADPH oxidase. The mammalian cell may include a polynucleotide encoding the water-forming NADPH oxidase, which may optionally be under the control of a mammalian promoter. The polynucleotide may be codon-optimized for expression in a mammalian cell. The polynucleotide may be integrated into the nuclear or mitochondrial genome of a mammalian cell (e.g., a human cell). In particular, the NADPH oxidase is not endogenous to the mammalian cell. The water-forming NADPH oxidase may have a polypeptide sequence having at least 85%, 90%, 95%, 97%, 99%, or 100% sequence identity to the sequence of SEQ ID NOs: 329 or 330. For example, the water-forming NADPH oxidase may have a polypeptide sequence having at least 85%, 90%, 95%, 97%, 99%, or 100% sequence identity to the sequence of SEQ ID NO: 329 and having one or more (e.g., one, two, three, four, or all five) of the following mutations relative to SEQ ID NO: 1: G158A, D176A, A177R, M178S, and P183R. For instance, the polypeptide may have a polypeptide sequence having at least 85%, 90%, 95%, 97%, 99%, or 100% sequence identity to the sequence of SEQ ID NO: 329 and a G158A mutation relative to SEQ ID NO: 1. The polypeptide may have a polypeptide sequence having at least 85%, 90%, 95%, 97%, 99%, or 100% sequence identity to the sequence of SEQ ID NO: 329 and a D176A mutation relative to SEQ ID NO: 1. The polypeptide may have a polypeptide sequence having at least 85%, 90%, 95%, 97%, 99%, or 100% sequence identity to the sequence of SEQ ID NO: 329 and a A177R mutation relative to SEQ ID NO: 1. The polypeptide may have a polypeptide sequence having at least 85%, 90%, 95%, 97%, 99%, or 100% sequence identity to the sequence of SEQ ID NO: 329 and a M178S mutation relative to SEQ ID NO: 1. The polypeptide may have a polypeptide sequence having at least 85%, 90%, 95%, 97%, 99%, or 100% sequence identity to the sequence of SEQ ID NO: 329 and a P183R mutation relative to SEQ ID NO: 1. In some embodiments, the polypeptide has a polypeptide sequence having at least 85%, 90%, 95%, 97%, 99%, or 100% sequence identity to the sequence of SEQ ID NO: 329 and additionally contains two of the mutations G158A, D176A, A177R, M178S, and P183R relative to SEQ ID NO: 1. In some embodiments, the polypeptide has a polypeptide sequence having at least 85%, 90%, 95%, 97%, 99%, or 100% sequence identity to the sequence of SEQ ID NO: 329 and additionally contains three of the mutations G158A, D176A, A177R, M178S, and P183R relative to SEQ ID NO: 1. In some embodiments, the polypeptide has a polypeptide sequence having at least 85%, 90%, 95%, 97%, 99%, or 100% sequence identity to the sequence of SEQ ID NO: 329 and additionally contains four of the mutations G158A, D176A, A177R, M178S, and P183R relative to SEQ ID NO: 1. In some embodiments, the polypeptide has a polypeptide sequence having at least 85%, 90%, 95%, 97%, 99%, or 100% sequence identity to the sequence of SEQ ID NO: 329 and additionally contains the mutations G158A, D176A, A177R, M178S, and P183R relative to SEQ ID NO: 1. In some embodiments, the NADPH oxidase contains a polypeptide sequence having at least 85%, 90%, 95%, 97%, 99%, or 100% sequence identity to the sequence of SEQ ID NO: 330, wherein the NADH oxidase contains one or more mutations in the cofactor specific loop region (residues 191-198) of SEQ ID NO: 4, such as a mutation selected from the group consisting of D191A, V192R, V193H, and A198R relative to the amino acid sequence of SEQ ID NO: 4.

The water-forming NADPH oxidase may exhibit various biochemical properties. For instance, a water-forming NADPH oxidase may:

a) exhibit a Km value for NADPH of no more than about 100 μM (e.g., a Km value for NADPH of from about 100 nM to about 100 μM, such as a Km value for NADPH of from 20 μM to about 25 μM); and/or b) be capable of selectively oxidizing NADPH over NADH (e.g., exhibits a $k_{cat}/K_M$ for NADPH that is increased by 10-fold, 20-fold, 30-fold, 40-fold, 50-fold, 60-fold, 70-fold, 80-fold, 90-fold, 100-fold, 200-fold, 300-fold, 400-fold, 500-fold, 600-fold, 700-fold, 800-fold, 900-fold, 1,000-fold, 1,100-fold, 1,200-fold, 1,300-fold, 1,400-fold, 1,500-fold, 1,600-fold, 1,700-fold, 1,800-fold, 1,900-fold, 2,000-fold, 3,000-fold, 4,000-fold, 5,000-fold, 10,000-fold, or more, relative to the $k_{cat}/K_M$ exhibited for NADH); and/or c) be capable of increasing oxygen consumption by a mammalian cell (e.g., a human cell, for instance, by 1.1-fold to 10-fold (e.g., 1.1-fold, 1.2-fold, 1.3-fold, 1.4-fold, 1.5-fold, 1.6-fold, 1.7-fold, 1.8-fold, 1.9-fold, 2.0-fold, 2.1-fold, 2.2-fold, 2.3-fold, 2.4-fold, 2.5-fold, 2.6-fold, 2.7-fold, 2.8-fold, 2.9-fold, 3.0-fold, 3.5-fold, 4.0-fold, 4.5-fold, 5.0-fold, 5.5-fold, 6.0-fold, 7.0-fold, 8.0-fold, 9.0-fold, or 10.0-fold, or more).

The invention also features a water-forming NADPH oxidase that may be prepared as a fusion protein. The fusion protein may contain the NADPH oxidase and an additional molecule, which may be an antibody Fc region, a cell-penetrating peptide (such as a peptide having the sequence of any one of SEQ ID NOs: 279-297), a molecule that increases the serum half-life of the fusion protein, a molecule that increases the solubility of the NADH oxidase, or a targeting molecule (such as a polypeptide, a saccharide, a lipid, or a small molecule) that selectively localizes to a particular organelle (e.g., the mitochondria) within the cell. The targeting molecule may be the mitochondrial targeting sequence of subunit IV of human cytochrome c oxidase.

The invention also features a polynucleotide that encodes a water-forming NADPH oxidase containing a polypeptide sequence having at least 85%, 90%, 95%, 97%, 99%, or 100% sequence identity to SEQ ID NO: 329. For instance, the polypeptide may have at least 85%, 90%, 95%, 97%, 99%, or 100% sequence identity to SEQ ID NO: 329 and one or more (e.g., one, two, three, four, or all five) of the following mutations relative to SEQ ID NO: 1: G158A, D176A, A177R, M178S, and P183R. For instance, the polypeptide may have a polypeptide sequence having at least 85%, 90%, 95%, 97%, 99%, or 100% sequence identity to the sequence of SEQ ID NO: 329 and a G158A mutation relative to SEQ ID NO: 1. The polypeptide may have a polypeptide sequence having at least 85%, 90%, 95%, 97%, 99%, or 100% sequence identity to the sequence of SEQ ID NO: 329 and a D176A mutation relative to SEQ ID NO: 1. The polypeptide may have a polypeptide sequence having at least 85%, 90%, 95%, 97%, 99%, or 100% sequence identity to the sequence of SEQ ID NO: 329 and a A177R mutation relative to SEQ ID NO: 1. The polypeptide may have a polypeptide sequence having at least 85%, 90%, 95%, 97%, 99%, or 100% sequence identity to the sequence of SEQ ID NO: 329 and a M178S mutation relative to SEQ ID NO: 1. The polypeptide may have a polypeptide sequence having at least 85%, 90%, 95%, 97%, 99%, or 100% sequence identity to the sequence of SEQ ID NO: 1 and a P183R mutation relative to SEQ ID NO: 1. In some embodiments, the polypeptide has a polypeptide sequence having at least 85%, 90%, 95%, 97%, 99%, or 100% sequence identity to the sequence of SEQ ID NO: 1 and additionally contains two of the mutations G158A, D176A, A177R, M178S, and P183R relative to SEQ ID NO: 1. In some embodiments, the polypeptide has a polypeptide sequence having at least 85%, 90%, 95%, 97%, 99%, or 100% sequence identity to the sequence of SEQ ID NO: 329 and additionally contains three of the mutations G158A, D176A, A177R, M178S, and P183R relative to SEQ ID NO: 1. In some embodiments, the polypeptide has a polypeptide sequence having at least 85%, 90%, 95%, 97%, 99%, or 100% sequence identity to the sequence of SEQ ID NO: 329 and additionally contains four of the mutations G158A, D176A, A177R, M178S, and P183R relative to SEQ ID NO: 1. In some embodiments, the polypeptide has a polypeptide sequence having at least 85%, 90%, 95%, 97%, 99%, or 100% sequence identity to the sequence of SEQ ID NO: 329 and additionally contains the mutations G158A, D176A, A177R, M178S, and P183R relative to SEQ ID NO: 1. The NADPH oxidase may contain a polypeptide sequence having at least 85%, 90%, 95%, 97%, 99%, or 100% sequence identity to the sequence of SEQ ID NO: 330, wherein the NADH oxidase contains one or more mutations in the cofactor specific loop region (residues 191-198) of SEQ ID NO: 4, such as a mutation selected from the group consisting of D191A, V192R, V193H, and A198R relative to the amino acid sequence of SEQ ID NO: 4.

In some embodiments, the polynucleotide is under the control of a mammalian promoter and/or also includes a nucleic acid sequence that encodes a cell-penetrating peptide or a peptide that localizes to a particular organelle within a mammalian cell (e.g., a human cell). The polynucleotide may be codon-optimized for expression in a mammalian cell. The polynucleotide may be part of a transposable element, which may optionally contain a transposase recognition and/or cleavage element that may promote incorporation into a deoxyribonucleic acid (DNA) molecule of a mammalian cell, such as nuclear or mitochondrial DNA. The water-forming NADPH oxidase encoded by a polynucleotide of the invention may have at least 85%, 90%, 95%, 97%, 99%, or 100% sequence identity to the sequence of SEQ ID NOs: 329 or 330, such as a variant of SEQ ID NO: 329 or 330 described above, and may optionally have any of the biochemical properties described above. The NADPH oxidase encoded by a polynucleotide of the invention may also be a fusion protein as described above, such that the components of the fusion protein are proteinogenic.

The invention also features a vector containing a polynucleotide that encodes a water-forming NADPH oxidase. The vector may be an expression vector, such as a eukaryotic expression vector, or a viral vector, such as an adenovirus (e.g., a serotype 5, 26, 35, or 48 adenovirus), retrovirus (e.g., a γ-retrovirus or a lentivirus), poxvirus, adeno-associated virus, baculovirus, herpes simplex virus, and a vaccinia virus (e.g., modified vaccinia Ankara (MVA)). The NADH oxidase encoded by the polynucleotide may be a fusion protein, such as those described above and herein.

The invention also features an isolated polypeptide having at least 85%, 90%, 95%, 97%, 99%, or 100% sequence identity to SEQ ID NO: 329. For instance, the polypeptide may have at least 85%, 90%, 95%, 97%, 99%, or 100% sequence identity to SEQ ID NO: 329 and one or more (e.g., one, two, three, four, or all five) of the following mutations relative to SEQ ID NO: 1: G158A, D176A, A177R, M178S, and P183R. For instance, the polypeptide may have a polypeptide sequence having at least 85%, 90%, 95%, 97%, 99%, or 100% sequence identity to the sequence of SEQ ID NO: 329 and a G158A mutation relative to SEQ ID NO: 1. The polypeptide may have a polypeptide sequence having at least 85%, 90%, 95%, 97%, 99%, or 100% sequence identity to the sequence of SEQ ID NO: 329 and a D176A mutation relative to SEQ ID NO: 1. The polypeptide may have a polypeptide sequence having at least 85%, 90%, 95%, 97%, 99%, or 100% sequence identity to the sequence of SEQ ID NO: 329 and a A177R mutation relative to SEQ ID NO: 1. The polypeptide may have a polypeptide sequence having at least 85%, 90%, 95%, 97%, 99%, or 100% sequence identity to the sequence of SEQ ID NO: 329 and a M178S mutation relative to SEQ ID NO: 1. The polypeptide may have a polypeptide sequence having at least 85%, 90%, 95%, 97%, 99%, or 100% sequence identity to the sequence of SEQ ID NO: 1 and a P183R mutation relative to SEQ ID NO: 1. In some embodiments, the polypeptide has a polypeptide sequence having at least 85%, 90%, 95%, 97%, 99%, or 100% sequence identity to the sequence of SEQ ID NO: 1 and additionally contains two of the mutations G158A, D176A, A177R, M178S, and P183R relative to SEQ ID NO: 1. In some embodiments, the polypeptide has a polypeptide sequence having at least 85%, 90%, 95%, 97%, 99%, or 100% sequence identity to the sequence of SEQ ID NO: 329 and additionally contains three of the mutations G158A, D176A, A177R, M178S, and P183R relative to SEQ ID NO: 1. In some embodiments, the polypeptide has a polypeptide sequence having at least 85%, 90%, 95%, 97%, 99%, or 100% sequence identity to the sequence of SEQ ID NO: 329 and additionally contains four of the mutations G158A, D176A, A177R, M178S, and P183R relative to SEQ ID NO: 1. In some embodiments, the polypeptide has a polypeptide sequence having at least 85%, 90%, 95%, 97%, 99%, or 100% sequence identity to the sequence of SEQ ID NO: 329 and additionally contains the mutations G158A, D176A, A177R, M178S, and P183R relative to SEQ ID NO: 1.

The invention further includes polypeptide containing a water-forming NADPH oxidase and an additional molecule at the N- or C-terminus of the polypeptide, optionally tethered by a linker. The polypeptide may have, for instance, at least 85%, 90%, 95%, 97%, 99%, or 100% sequence identity to the sequence of SEQ ID NO: 329 or 330, such as a variant of SEQ ID NO: 329 described above. In some embodiments, the NADPH oxidase contains a polypeptide sequence having at least 85%, 90%, 95%, 97%, 99%, or 100% sequence identity to the sequence of SEQ ID NO: 330, wherein the NADH oxidase contains one or more mutations in the cofactor specific loop region (residues 191-198) of SEQ ID NO: 4, such as a mutation selected from the group consisting of D191A, V192R, V193H, and A198R relative to the amino acid sequence of SEQ ID NO: 4. The linker may be a peptide containing one or more amino acids, including D- or L-amino acids and/or non-naturally occurring amino acids. Alternatively, the linker may be a non-peptidic molecule. In particular embodiments, the linker may be cleavable, for example, by a process such as enzymatic hydrolysis, photolysis, hydrolysis under acidic conditions, hydrolysis under basic conditions, oxidation, disulfide reduction, nucleophilic cleavage, and organometallic cleavage. The NADPH oxidase may have any of the biochemical properties or sequence characteristics described above. The NADPH oxidase may be capable of selectively increasing the total ratio of $NADP^+$ to NADPH (e.g., by 2-fold, 5-fold, 10-fold, 20-fold, 100-fold, or more) in an organelle without significantly altering the ratio in a different organelle. The additional molecule may be an antibody Fc region, a cell-penetrating peptide (e.g., as described above), a molecule that increases the serum half-life of the polypeptide, a molecule that increases the solubility of the NADPH oxidase, or a targeting molecule that selectively localizes the polypeptide to a particular organelle within a mammalian cell (such as one that localizes to the mitochondria, nucleus, golgi, endoplasmic reticulum, lysosome, peroxisome, or adiposome, e.g., a peptide containing subunit IV of human cytochrome c oxidase that is directed to the mitochondria). The polypeptide may contain a first molecule that is capable of being selectively bound (e.g., with a $K_D$ of 100 nM or less) by a second molecule. For instance, the first molecule may be an epitope tag, such as maltose-binding protein, glutathione-S-transferase, a poly-histidine tag, a FLAG-tag, a myc-tag, human influenza hemagglutinin (HA) tag, biotin, or streptavidin. The second molecule may be maltose, glutathione, a nickel-containing complex, an anti-FLAG antibody, an anti-myc antibody, an anti-HA antibody, biotin, or streptavidin. The polypeptide may optionally contain a fluorescent molecule, such as green fluorescent protein, cyan fluorescent protein, yellow fluorescent protein, red fluorescent protein, phycoerythrin, allophycocyanin, hoescht, 4',6-diamidino-2-phenylindole (DAPI), propidium iodide, fluorescein, coumarin, rhodamine, tetramethylrhoadmine, and cyanine.

The invention also features a composition containing a water-forming NADH or NADPH oxidase suitable for administration to a mammal (e.g., a human) that can be used to treat a particular disease. In certain embodiments, the water-forming NADH or NADPH oxidase may have any of the biochemical properties as described above, and/or may optionally be a fusion protein as described above. The composition may include a complex, such as a liposome or nanoparticle, that contains the water-forming NADH oxidase or NADPH. The composition may be formulated for intravenous, intramuscular, oral, parenteral, intraperitoneal, intraarterial, transdermal, sublingual, nasal, transbuccal, liposomal, adiposal, opthalmic, intraocular, subcutaneous, intrathecal, topical, or local administration or by inhalation. The composition may be used to treat a disease or condition in a mammal (e.g., a human) caused by mitochondrial dysfunction. The composition may include one or more mammalian cells, polynucleotides, vectors, or polypeptides of the invention. The mitochondrial dysfunction may be caused by a defect in at least one component of the respiratory chain, such as one or more defects in complex I, II, III, and/or IV. For instance, the disease or condition may be mitochondrial myopathy, Wolff-Parkinsons-White syndrome, neuropathy, ataxia, Friedreich's ataxia, retinitis pigmentosa, and ptosis (NARP), myoneurogenic gastrointestinal encephalopathy (MNGIE), myoclonic epilepsy with ragged red fibers (MERRF), mitochondrial encephalomyopathy, lactic acidosis, and stroke-like symptoms (MELAS), mitochondrial DNA depletion, chronic progressive external ophthalmoplegia, Kearns-Sayre syndrome, Leber hereditary optic neuropathy, mitochondrial encephalomyopathy, myoclonic epilepsy myopathy sensory ataxia (MEMSA), myoclonic epilepsy, mitochondrial recessive ataxia syndrome, sensory ataxia neuropathy, dysarthria, ophthalmoplegia, spinocerebellar ataxia, sarcopenia, skeletal muscle atrophy, lactic acidosis, seizures, stroke-like episodes, gray or white matter disease, autonomic dysfunction, cardiac conduction defects, cardiomyopathy, pancreatic exocrine or endocrine dysfunction, skeletal muscle myopathy, peripheral neuropathy, blindness, gastrointestinal dysmotility, deafness, liver failure, or kidney failure. The disease or condition may be a neurodegenerative disease (e.g., Parkinson's disease), a glucose metabolism disorder (e.g., diabetes or obesity), or aging.

The compositions of the invention may also be used to treat cancer in a mammal, such as a human patient. For instance, one or more mammalian cells, polynucleotides, vectors, or polypeptides of the invention may be administered to a mammal (e.g., a human) in order to treat a particular cancer, such as breast cancer, paraganglioma, phaeochromocytoma, leiomyoma, leiomyosarcoma, or renal cell carcinoma. Compositions of the invention may also be used in the manufacture of a medicament for treating any of the above-described disorders.

In addition to their utility as therapeutics for human disease, a composition of the invention (such as the above-described mammalian cells, polynucleotides, vectors, and polypeptides) may also be used as a research tool in analyzing an effect of one or more water-forming NADH or NADPH oxidases on a mammalian cell. For instance, the compositions of the invention may be used to investigate a change in the ratio of $NAD^+$ or $NADP^+$ to NADH or NADPH, a change in the ratio of lactate to pyruvate, a change in the rate of gluconeogenesis, or a change in the phosphorylation state of PDH in a mammalian cell or in a specific organelle within the mammalian cell. The invention also features a method of analyzing an effect of one or more water-forming NADH or NADPH oxidases on a mammalian cell by contacting the mammalian cell with a polynucleotide, vector, polypeptide, or other composition of the invention as described above. For instance, using the methods of the invention, one can determine the presence or activity of a water-forming NADH or NADPH oxidase in a mammalian cell. Optionally, the methods of the invention may include determining the absolute or relative concentration of one or more molecules that is produced or released by a mammalian cell containing a water-forming NADH or NADPH oxidase as a result of a chemical reaction that occurs during cellular respiration. Exemplary molecules that can be analyzed according to the methods of the invention include lactate, pyruvate, phosphorylated PDH, $NAD^+$, $NADP^+$, NADH or NADPH, FAD, $FADH_2$, and molecular oxygen. Methods of the invention may also include determining the viability of a mammalian cell.

The invention also features kits that can be used to analyze an effect of water-forming NADH or NADPH oxidase activity in a mammalian cell or within a specific organelle within the mammalian cell, such as the biochemical effects described above. Such kits may contain one or more of the mammalian cells, polynucleotides, vectors, polypeptides, or compositions of the invention described above, as well as instructions for the use of the kit. For instance, a kit of the invention may include a reagent capable of inducing expression of a water-forming NADH or NADPH oxidase in a mammalian cell, or one or more reagents capable of detecting the presence of a water-forming NADH or NADPH oxidase. For instance, a kit of the invention may contain a reagent capable of binding an additional molecule covalently linked to a water-forming NADH or NADPH oxidase, such as an epitope tag as described above. A kit of the invention may optionally contain one or more reagents capable of detecting the enzymatic activity of a water-forming NADH or NADPH oxidase by detecting a product of the chemical reaction catalyzed the NADH or NADPH oxidase. The reagent may be a substrate capable of being oxidized by $NAD^+$ or $NADP^+$ to produce NADH or NADPH, and the kit may also include an enzyme capable of catalyzing the oxidation of the substrate. A kit may further include a substrate capable of being reduced by NADH or NADPH, and/or an enzyme capable of catalyzing this reduction. The activity of the NADH or NADPH oxidase may be determined, for example, by detecting the presence of a product of the reduction reaction.

Definitions

As used herein, the term "cell-penetrating peptide" refers to a polypeptide that is capable of crossing a cell membrane (e.g., a mammalian cell membrane) and entering the intracellular environment. A cell-penetrating peptide may cross or penetrate a cell membrane by any of a variety of mechanisms, including via endocytosis, macropinocytosis, and passive diffusion through membrane pores, among others. A cell-penetrating peptide may be capable of translocating a molecule to which it is chemically bound (e.g., a polypeptide bound by a covalent bond to the cell-penetrating peptide) across a cell membrane. Cell-penetrating peptides include those that enter the cell via endocytosis and reside within endocytic vesicles. In certain cases, as an endocytic vesicle matures, a cell-penetrating peptide may enter the cytosol of a cell. Under other conditions, a vesicle containing a cell-penetrating peptide may fuse to another organelle within a cell, releasing the contents of the vesicle into the organelle.

As used herein, the term "chelating group" refers to a molecule or ion capable of forming more than one chemical bond with a metal cation.

As used herein, the term "codon-optimized" describes a polynucleotide sequence in which one or more codons has been modified (e.g., by substitution of one nucleotide within a codon with another nucleotide) so as to increase the expression level of the polypeptide encoded by the polynucleotide in a particular cell (e.g., a human cell).

As used herein, the term "conjugate" refers to a compound formed by the covalent bonding of a reactive functional group of one molecule with an appropriately reactive functional group of another molecule.

As used herein, the term "endogenous" describes a molecule (e.g., a polypeptide, nucleic acid, or cofactor) that is found naturally in a particular organism (e.g., a human) or in a particular location within an organism (e.g., an organ, a tissue, or a cell, such as a human cell).

As used herein, the term "exogenous" describes a molecule (e.g., a polypeptide, nucleic acid, or cofactor) that is not found naturally in a particular organism (e.g., a human) or in a particular location within an organism (e.g., an organ, a tissue, or a cell, such as a human cell). Exogenous materials include those that are provided from an external source to an organism or to cultured matter extracted there from.

As used herein, the term "fusion protein" refers to a protein that is joined via a covalent bond to another molecule. A fusion protein can be chemically synthesized by, e.g., an amide-bond forming reaction between the N-terminus of one protein to the C-terminus of another protein.

Alternatively, a fusion protein containing one protein covalently bound to another protein can be expressed recombinantly in a cell (e.g., a mammalian cell) by expression of a polynucleotide encoding the fusion protein, for example, from a vector or the genome of the cell. A fusion protein may contain one protein that is covalently bound to a linker, which in turn is covalently bound to another molecule. Examples of linkers that can be used for the formation of a fusion protein include peptide-containing linkers, such as those that contain naturally occurring or non-naturally occurring amino acids. In certain cases, it may be desirable to include D-amino acids in the linker, as these residues are not present in naturally-occurring proteins and are thus more resistant to degradation by endogenous proteases. Linkers can be prepared using a variety of strategies that are well known in the field, and depending on the reactive components of the linker, can be cleaved by enzymatic hydrolysis, photolysis, hydrolysis under acidic conditions, hydrolysis under basic conditions, oxidation, disulfide reduction, nucleophilic cleavage, or organometallic cleavage (Leriche, et al., Bioorg. Med. Chem., 20:571-582, 2012).

As used herein, the term "percent (%) sequence identity" refers to the percentage of amino acid (or nucleic acid) residues of a candidate sequence that are identical to the amino acid (or nucleic acid) residues of a reference sequence after aligning the sequences and introducing gaps, if necessary, to achieve the maximum percent sequence identity (e.g., gaps can be introduced in one or both of the candidate and reference sequences for optimal alignment and non-homologous sequences can be disregarded for comparison purposes). Alignment for purposes of determining percent sequence identity can be achieved in various ways, for instance, using publicly available computer software, such as BLAST, ALIGN, or Megalign (DNASTAR) software. Those skilled in the field can determine appropriate parameters for measuring alignment, including any algorithms needed to achieve maximal alignment over the full length of the sequences being compared. For example, a reference sequence aligned for comparison with a candidate sequence may show that the candidate sequence exhibits from 50% to 100% sequence identity across the full length of the candidate sequence or a selected portion of contiguous amino acid (or nucleic acid) residues of the candidate sequence. The length of the candidate sequence aligned for comparison purposes may be, for example, at least 30%, (e.g., 30%, 40%, 50%, 60%, 70%, 80%, 90%, or 100%) of the length of the reference sequence. When a position in the candidate sequence is occupied by the same amino acid residue as the corresponding position in the reference sequence, then the molecules are identical at that position.

As used herein, the term "pharmacokinetic profile" refers to the absorption, distribution, metabolism, and elimination of a drug over time following administration to a patient.

As used herein, the terms "subject" and "patient" refer to an organism that receives treatment for a particular disease or condition as described herein. Examples of subjects and patients include mammals, such as humans, receiving treatment for diseases or conditions, for example, those associated with dysfunction of the mitochondrial respiratory chain.

As used herein, the term "variant" in the context of a water-forming NADH oxidase of the invention refers to a water-forming NADH oxidase having a polypeptide sequence that differs from the sequence of any one of SEQ ID NOs: 1-273 and has 85% sequence identity or greater (e.g., 85%, 90%, 95%, 97%, 99% sequence identity) relative to the polypeptide sequence of any one of SEQ ID NOs: 1-273. The term "variant" in the context of a water-forming NADPH oxidase of the invention refers to a water-forming NADPH oxidase having a polypeptide sequence that differs from the sequence of any one of SEQ ID NOs: 329 and 330 and has 85% sequence identity or greater (e.g., 85%, 90%, 95%, 97%, 99% sequence identity) relative to the polypeptide sequence of any one of SEQ ID NOs: 329 and 330.

As used herein, the term "vector" includes a nucleic acid vector, e.g., a DNA vector, such as a plasmid, a RNA vector, virus or other suitable replicon (e.g., viral vector).

As used herein, the term "water-forming NADH oxidase" refers to an enzyme that is capable of producing (e.g., regenerating) nicotinamide adenine dinucleotide ($NAD^+$) from the reduced form of this compound, NADH. A water-forming NADH oxidase is also capable of reducing molecular oxygen ($O_2$) to water ($H_2O$). In certain cases, water-forming NADH oxidases may selectively catalyze the oxidation of NADH to $NAD^+$. For instance, the water-forming NADH oxidase may exhibit a $k_{cat}/K_M$ for NADH that is increased by 10-fold, 20-fold, 30-fold, 40-fold, 50-fold, 60-fold, 70-fold, 80-fold, 90-fold, 100-fold, 200-fold, 300-fold, 400-fold, 500-fold, 600-fold, 700-fold, 800-fold, 900-fold, 1,000-fold, 1,100-fold, 1,200-fold, 1,300-fold, 1,400-fold, 1,500-fold, 1,600-fold, 1,700-fold, 1,800-fold, 1,900-fold, 2,000-fold, 3,000-fold, 4,000-fold, 5,000-fold, 10,000-fold, or more, relative to the $k_{cat}/K_M$ exhibited for NADPH. In other cases, water-forming NADH oxidases may be capable of converting another substrate (e.g., NADPH) to its oxidized state (e.g., $NADP^+$). Water-forming NADH oxidases may use a cofactor in order to oxidize a particular substrate. For instance, a water-forming NADH oxidase may transfer electrons from a substrate (e.g., NADH or NADPH) to a cofactor (e.g., flavin adenine dinucleotide, FAD) in order to oxidize the substrate. A water-forming NADH oxidase may subsequently transfer electrons from a cofactor to molecular oxygen in order to form water, as determined, e.g., by an oxygen consumption assay, for instance, as described in Example 11 below.

As used herein, the term "water-forming NADPH oxidase" refers to an enzyme that is capable of producing (e.g., regenerating) nicotinamide adenine dinucleotide phosphate ($NADP^+$) from the reduced form of this compound, NADPH. A water-forming NADPH oxidase is also capable of reducing molecular oxygen ($O_2$) to water ($H_2O$). In certain cases, water-forming NADPH oxidases may selectively catalyze the oxidation of NADPH to $NADP^+$. For instance, the water-forming NADPH oxidase may exhibit a $k_{cat}/K_M$ for NADPH that is increased by 10-fold, 20-fold, 30-fold, 40-fold, 50-fold, 60-fold, 70-fold, 80-fold, 90-fold, 100-fold, 200-fold, 300-fold, 400-fold, 500-fold, 600-fold, 700-fold, 800-fold, 900-fold, 1,000-fold, 1,100-fold, 1,200-fold, 1,300-fold, 1,400-fold, 1,500-fold, 1,600-fold, 1,700-fold, 1,800-fold, 1,900-fold, 2,000-fold, 3,000-fold, 4,000-fold, 5,000-fold, 10,000-fold, or more, relative to the $k_{cat}/K_M$ exhibited for NADH. In other cases, water-forming NADH oxidases may be capable of converting another substrate (e.g., NADH) to its oxidized state (e.g., $NADP^+$). Water-forming NADPH oxidases may use a cofactor in order to oxidize a particular substrate. For instance, a water-forming NADPH oxidase may transfer electrons from a substrate (e.g., NADPH) to a cofactor (e.g., flavin adenine dinucleotide, FAD) in order to oxidize the substrate. A water-forming NADPH oxidase may subsequently transfer electrons from a cofactor to molecular oxygen in order to form water, as determined, e.g., by an oxygen consumption assay, for instance, as described in Example 11 below.

BRIEF DESCRIPTION OF THE FIGURES

(FIG. 1A) Reaction catalyzed by LbNOX. (FIG. 1B) UV-visible spectrum of purified LbNOX. Protein (82.8 µM FAD active sites) in 50 mM NaPi pH 7.5, 150 mM NaCl after purification in oxidized form (solid line) and after addition of excess of sodium dithionite, reduced form (dashed line). Inset: SDS-PAGE of purified LbNOX. (FIG. 1C) Simultaneous measurement of NADH and oxygen consumption by LbNOX as assayed in 50 mM NaPi pH 7.5, 150 mM NaCl at 28° C. NADH (500 µM) and LbNOX (1.8 µg) were added as indicated by arrows. (FIG. 1D) Michaelis-Menten analysis of the NAD(P)H oxidase activity of recombinant LbNOX. Inset: values for $V_{max}$ and $K_M$ for NADH represent the mean±S.D. (error bars) from four independent experiments. (FIG. 1E) The crystal structure of LbNOX. The FAD in stick representation and bound oxygen in red spheres. Inset: The substrate selectivity loops of LbNOX (containing Asp177, Ala178, and Pro184) and glutathione reductase—NADPH complex (containing Arg198 and Arg204) (PDB ID 1GET). Backbone atoms of NAD(P)H binding domains of each protein (residues 147-247 of LbNOX and 167-268 of glutathione reductase) were superimposed using the least square algorithm of COOT. Note that Arg198 and Arg204 of glutathione reductase, which tightly bind the phosphate moiety of NADPH, are replaced in LbNOX with Ala178 and Pro184, respectively. Negatively charged side chain of Asp177 in LbNOX replaces the neutral Val197 of glutathione reductase.

(FIG. 2A) Western blot of LbNOX and mitoLbNOX expression in HeLa Tet3G LbNOX and mitoLbNOX cells after 24-hour treatment with water or 300 ng/ml doxycycline. (FIG. 2B) Subcellular localization of LbNOX and mitoLbNOX in HeLa Tet3G LbNOX and mitoLbNOX cells determined using fluorescence microscopy. Tomm20 is used as a marker of mitochondria. (FIG. 2C) Effect of LbNOX and mitoLbNOX expression in HeLa Tet3G LbNOX and mitoLbNOX cells on basal, piericidin-resistant and antimycin-resistant respiration measured with XF24 extracellular flux analyzer. Mean values±S.D. (error bars) from three independent experiments are shown.

(FIGS. 3A and 3B) Effect of LbNOX and mitoLbNOX expression in HeLa Tet3G LbNOX and mitoLbNOX cells on total intracellular NAD$^+$/NADH ratio (A), intracellular and secreted lactate/pyruvate (B). Mean values±S.E. (error bars) from four independent experiments are shown. (FIG. 3C) Effect of LbNOX and mitoLbNOX expression in HeLa Tet3G LbNOX and mitoLbNOX cells on PDH phosphorylation. (FIG. 3D) Effect of transduction by GFP, LbNOX and mitoLbNOX containing adenoviruses on gluconeogenesis in primary rat hepatocytes. Mean values±S.E. (error bars) from four independent experiments are shown. P value (* p<0.05) was calculated using one tailed ratio t test on non-normalized data using GraphPad Prism software.

(FIG. 4A) Effect of LbNOX and mitoLbNOX expression in HeLa Tet3G LbNOX and mitoLbNOX cells on inhibition of cell proliferation by piericidin, antimycin, chloramphenicol and ethidium bromide. Mean values±S.D. (error bars) from three independent experiments are shown. (FIG. 4B) Effect of pyruvate, oxaloacetate, lactate and malate addition on proliferation of HeLa Tet3G Luciferase cells in the presence or absence of 1 µM piericidin. Mean values±S.E. (error bars) from five independent experiments are shown.

(FIG. 9A) (error bars) or ±S.E.M. (FIGS. 9B and 9C) (error bars) from three (FIG. 9A) or four (FIGS. 9B and 9C) independent experiments are shown.

(FIGS. 10A, 10B, and 10E-10L) or S.E.M. (FIGS. 10C and 10D) (error bars) from three (FIGS. 10A, 10B, and 10E-10L) or five (FIGS. 10C and 10D) independent experiments are shown.

FIG. 16A shows the doxycycline-inducible expression of TPNOX and mitoTPNOX in HeLa cells. FIG. 16B shows that doxycycline-inducible expression of TPNOX and mitoTPNOX increases the oxygen consumption rate of HeLa cells. The activity data shown are depicted as the mean±SEM from n=3 independent experiments.

DETAILED DESCRIPTION

Figure 1A:
FIGS. 1A-1E illustrate the biochemical properties of LbNOX with a C-terminal FLAG tag and a cleavable N-terminal hexahistidine (Hisx6) tag produced by overexpression in *E. coli*. Purified LbNOX-FLAG has a yellow color and a UV-visible absorption spectrum ($\lambda_{max}$=371 and 444 nm) similar to other FAD-containing enzymes, which can be reduced upon the addition of sodium dithionite (FIG. 1B).
Figure 1B:
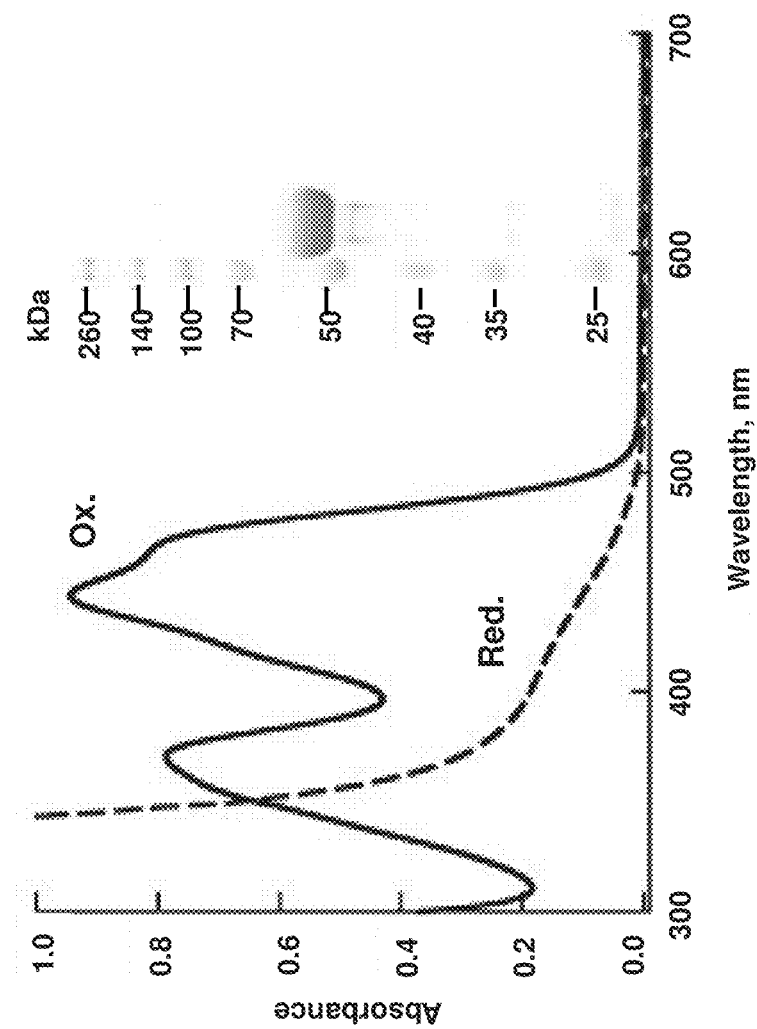
Figure 1C:
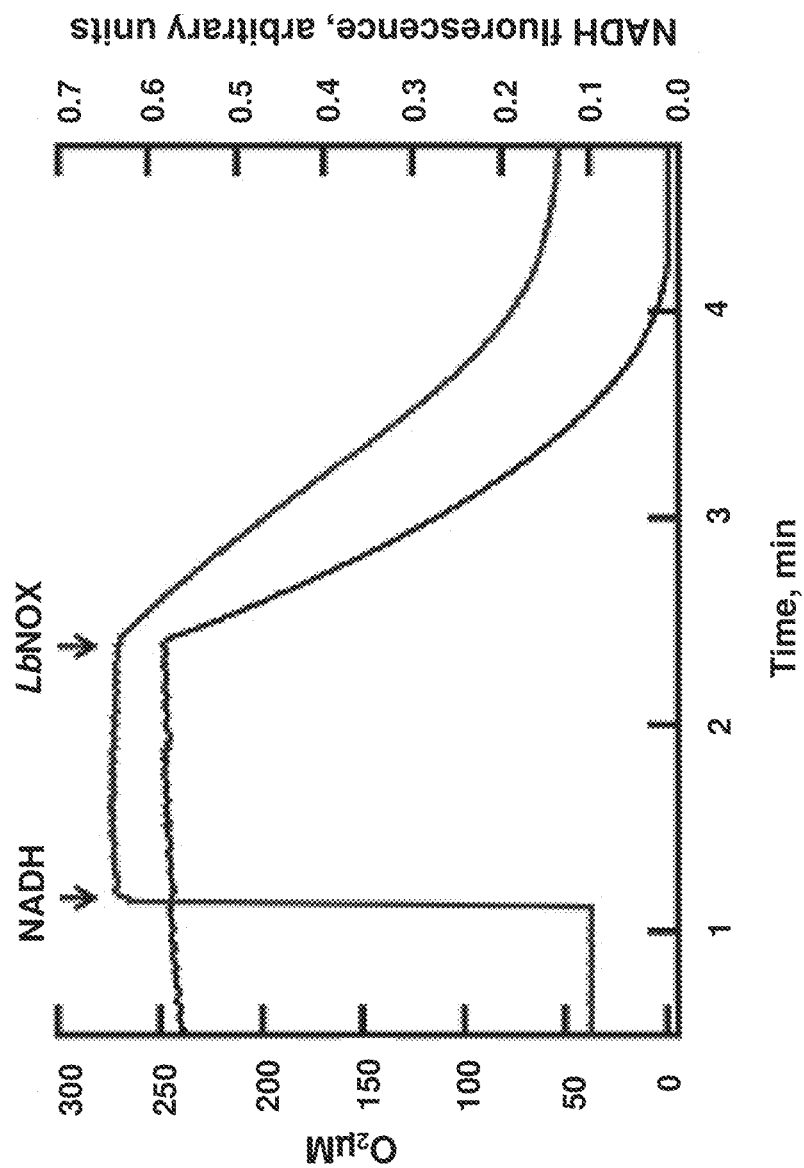
Figure 1D:
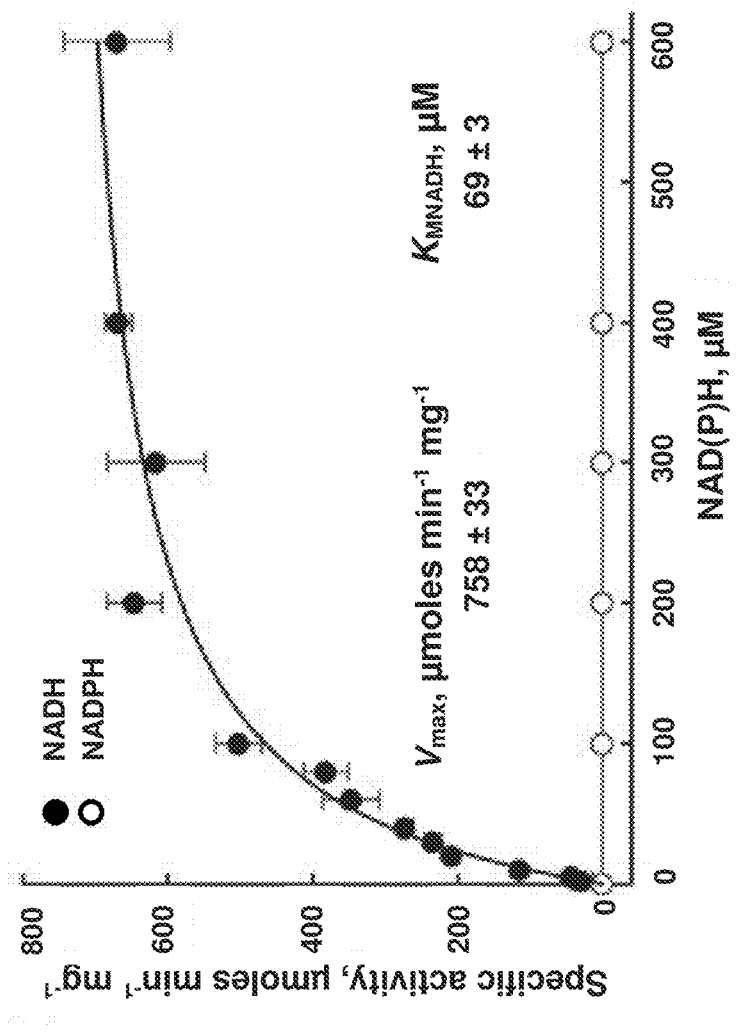

This invention is based in part on the surprising discovery that water-forming NADH oxidases can be used to alleviate a defective mammalian mitochondrial respiratory chain by oxidizing NADH and transferring electrons directly to molecular oxygen. In this way, $NAD^+$ is regenerated and is made available for important cellular processes. Rather than replacing or bypassing individual complexes of the respiratory chain in order to preserve the chemiosmotic gradient for ATP production, the water-forming NADH oxidases for use in the compositions and methods of the invention restore a significant yet oft-overlooked function of the respiratory chain: the recycling of NADH to $NAD^+$. Surprisingly, restoration of $NAD^+$ using water-forming NADH oxidases in the cytosol or mitochondria, even without directly restoring ATP production provided by the mitochondrial respiratory chain, can mitigate the metabolic inactivity characteristic of mammalian cells harboring a dysfunctional respiratory chain. Expression of water forming NADH oxidases, whether in the cytosol or in mitochondria, promotes the regeneration of NAD+, hence restoring one of the oft overlooked functions of the respiratory chain. Flux through important metabolic processes, such as nucleotide biosynthesis and glycolysis, can be restored by regenerating $NAD^+$, and, unexpectedly, this nascent activity can rescue a mammalian cell (e.g., a human cell) containing a defective mitochondrial respiratory chain. This discovery is nonintuitive, since a complete bypass of the respiratory chain by transferring electrons directly from NADH to oxygen would be predicted to be devastating to a cell, as it does not generate a proton gradient that can be used to catalyze ATP production at complex V, and the diminished mitochondrial production of ATP has long been considered the chief underlying cause of diseases associated with a dysfunctional respiratory chain. The discovery that underlies this invention is that it is not insufficient ATP that drives pathology, but rather inadequate regeneration of $NAD^+$, either within mitochondria or in the cytosol, with ensuing downstream metabolic and cellular consequences, that causes mitochondrial disease.

$NAD^+$ is an important cofactor that participates in many biochemical processes, including regulating protein folding, nucleotide biosynthesis, fatty acid biosynthesis, fatty acid oxidation, bile acid biosynthesis, porphyrin metabolism, glycolysis, alcohol detoxification, and cellular respiration, among others. Water-forming NADH oxidases can be used to restore $NAD^+$ reserves and quench excess NADH that accumulates in cells containing stalled respiratory chains. These enzymes do not naturally occur in mammalian cells. Rather, water-forming NADH oxidases have evolved in lower-order organisms, such as bacteria and single-celled eukaryotes, in order to restore NADH to its oxidized state or to keep oxygen tensions low in organisms that cannot tolerate high oxygen.

Gene therapy and protein therapy approaches to remedying mitochondrial pathology have focused on trying to replace individual mutant or otherwise defective components of the respiratory chain. However, more than 150 different nuclear and mitochondrial genes can be mutated to give rise to defects in the respiratory chain. Rather than targeting a specific component of the respiratory chain, water-forming NADH oxidases instead can act as a protein prosthesis that bypasses the defective respiratory chain entirely and provides an alternative pathway for $NAD^+$ regeneration. Thus, these enzymes are particularly useful for treating patients suffering from mixed respiratory chain deficiencies in which defects in complexes I, III, and IV are observed, as well as patients suffering from mutations in proteins that are responsible for the assembly, maintenance, or turnover of the respiratory chain. Water-forming NADH oxidases thus alleviate pathology by a mechanism very distinct from that of other oxidoreductases, such as yeast NDI1 and AOX. These enzymes need to be targeted to mitochondria and function by effectively replacing individual complexes of the respiratory chain, and they work by direct maintenance of a chemiosmotic gradient that promotes oxidative phosphorylation at complex V. Water-forming NADH oxidases do not need to be tailored to an individual complex of the respiratory chain that is defective in a given patient that presents with a particular disorder. Instead, these enzymes are capable of bypassing the defective respiratory chain entirely in order to restore oxidative balance, regardless of the unique components of the respiratory chain that may be deficient in a specific patient.

Water-forming NADH oxidases, as well as biologically active fragments thereof that maintain enzymatic activity, can be used for a broad array of applications. For example, these enzymes can be administered to a patient that is suffering from a defect in the mitochondrial respiratory chain in order to treat the disease, or to reduce one or more symptoms of the disease, by bypassing the defective components entirely. This can be achieved using any of several different strategies. For instance, a mammalian cell that has been engineered to express a water-forming NADH oxidase can be administered to such a patient. Alternatively, a polynucleotide encoding the enzyme can be administered to a patient, e.g., in the form of a vector. If desired, the vector may be one promotes the integration of the polynucleotide into the genome of the patient. The enzyme can also be administered directly to a patient, and a variety of strategies have been developed for administration of whole proteins that can be used to facilitate delivery of these enzymes to the appropriate cellular target.

Water-forming NADH or NADPH oxidases can be used as a research tool, for instance, in order to elucidate the effect of an exogenous water-forming oxidase on cell biology. Water-forming NADH oxidases can be used, for example, to study the role of the respiratory chain in the pathophysiology of various human diseases. Water-forming NADH oxidases can be used, e.g., to decouple the dual roles of the respiratory chain and analyze the effect of NADH oxidation in the absence of ATP production. Water-forming NADH and NADPH oxidases can also be used, for example, to study the effect of changes of the ratio of $NAD^+$ to NADH or $NADP^+$ to NADPH on different biological processes. The sections that follow will discuss compositions containing water-forming NADH or NADPH oxidases and methods for use thereof.

Biochemical Properties of Water-Forming NADH and NADPH Oxidases

The water-forming NADH or NADPH oxidases for use in the compositions and methods of the invention (for instance, a water-forming NADH oxidase having the amino acid sequence of any one of SEQ ID NOs: 1-273, such as a water-forming NADH oxidase having the amino acid sequence of any one of SEQ ID NOs: 1-5, or a water-forming NADPH oxidase having the amino acid sequence of SEQ ID NO: 329 or 330) can exhibit different substrate selectivity profiles. For example, these enzymes can catalyze the oxidation of NADH or NADPH to $NAD^+$ or $NADP^+$ and the concomitant reduction of molecular oxygen, $O_2$, to water ($H_2O$). The enzymes for use in the compositions and methods of the invention can be used, for example, to selectively catalyze the oxidation of NADH over NADPH, or to selectively catalyze the oxidation of NADPH over NADH. The water-forming NADH or NADPH oxidases for use in the compositions and methods of the invention may alternatively be pan-selective, and can therefore be used to catalyze the oxidation of NADH and NADPH.

The water-forming NADH or NADPH oxidases for use in the compositions and methods of the invention (for instance, a water-forming NADH oxidase having the amino acid sequence of any one of SEQ ID NOs: 1-273, such as a water-forming NADH oxidase having the amino acid sequence of any one of SEQ ID NOs: 1-5, or a water-forming NADPH oxidase having the amino acid sequence of SEQ ID NO: 329 or 330) contain binding sites for NADH or NADPH, and the molecular association of these enzymes with NADH or NADPH is characterized by Michaelis constant ($K_M$). These enzymes generally exhibit a $K_M$ for NADH or NADPH of between 1 µM and 500 µM (e.g., 500 µM, 490 µM, 480 µM, 470 µM, 460 µM, 450 µM, 440 µM, 430 µM, 420 µM, 410 µM, 400 µM, 390 µM, 380 µM, 370 µM, 360 µM, 350 µM, 340 µM, 330 µM, 320 µM, 310 µM, 300 µM, 290 µM, 280 µM, 270 µM, 260 µM, 250 µM, 240 µM, 230 µM, 220 µM, 200 µM, 190 µM, 180 µM, 170 µM, 160 µM, 150 µM, 140 µM, 130 µM, 120 µM, 110 µM, 100 µM, 95 µM, 90 µM, 85 µM, 80 µM, 75 µM, 70 µM, 65 µM, 60 µM, 55 µM, 50 µM, 45 µM, 40 µM, 35 µM, 30 µM, 25 µM, 20 µM, 15 µM, 10 µM, 5 µM, or 1 µM).

The water-forming NADH or NADPH oxidases for use in the compositions and methods of the invention (for instance, a water-forming NADH oxidase having the amino acid sequence of any one of SEQ ID NOs: 1-273, such as a water-forming NADH oxidase having the amino acid sequence of any one of SEQ ID NOs: 1-5, or a water-forming NADPH oxidase having the amino acid sequence of SEQ ID NO: 329 or 330) also bind molecular oxygen as a substrate for reduction, and generally exhibit a $K_M$ for $O_2$ between 1 µM and 500 µM (e.g., 500 µM, 490 µM, 480 µM, 470 µM, 460 µM, 450 µM, 440 µM, 430 µM, 420 µM, 410 µM, 400 µM, 390 µM, 380 µM, 370 µM, 360 µM, 350 µM, 340 µM, 330 µM, 320 µM, 310 µM, 300 µM, 290 µM, 280 µM, 270 µM, 260 µM, 250 µM, 240 µM, 230 µM, 220 µM, 200 µM, 190 µM, 180 µM, 170 µM, 160 µM, 150 µM, 140 µM, 130 µM, 120 µM, 110 µM, 100 µM, 95 µM, 90 µM, 85 µM, 80 µM, 75 µM, 70 µM, 65 µM, 60 µM, 55 µM, 50 µM, 45 µM, 40 µM, 35 µM, 30 µM, 25 µM, 20 µM, 15 µM, 10 µM, 5 µM, or 1 µM). For example, these enzymes may exhibit a $K_M$ for $O_2$ of below 20 µM (which is the approximate concentration of molecular oxygen in human venous blood).

Water-forming NADH oxidases (for instance, a water-forming NADH oxidase having the amino acid sequence of any one of SEQ ID NOs: 1-273, such as a water-forming NADH oxidase having the amino acid sequence of any one of SEQ ID NOs: 1-5) may produce hydrogen peroxide ($H_2O_2$) as a byproduct of the reduction of molecular oxygen to water. For example, the enzymes may produce between 0.1% and 50% of $H_2O_2$ by mole relative to $H_2O$ production (e.g., 50%, 45%, 40%, 35%, 30%, 25%, 20%, 15%, 10%, 5%, 2%, 1%, 0.5%, or 0.1%).

Figure 5A:
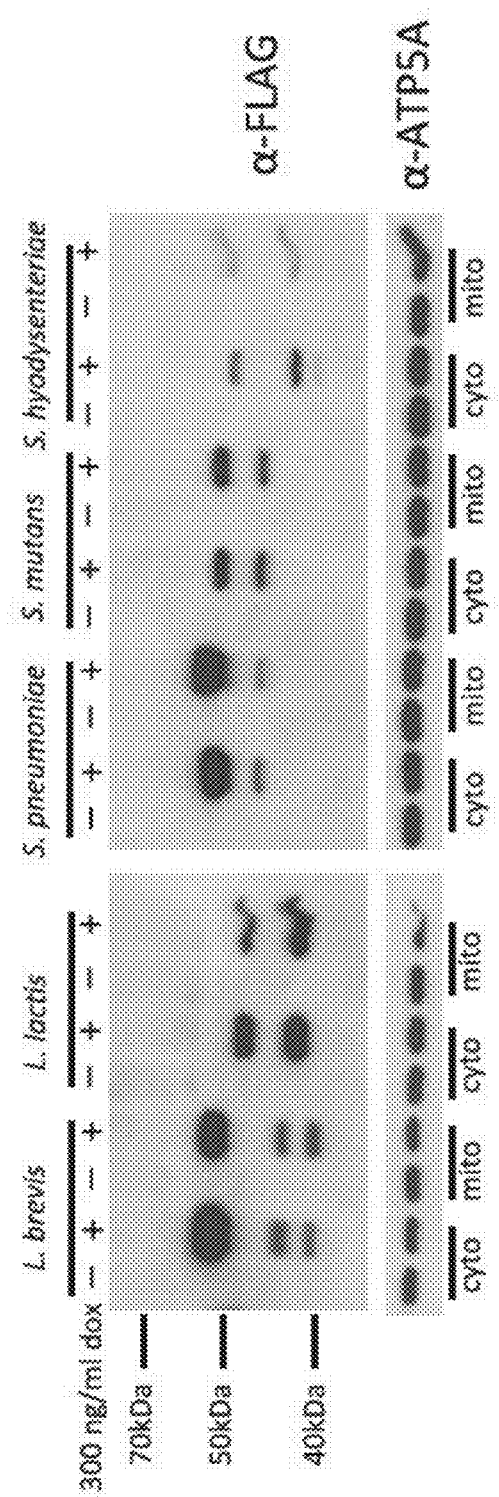
FIGS. 5A and 5B illustrate the expression (FIG. 5A) and effect on oxygen consumption rate (OCR) (FIG. 5B) of $H_2O$-forming NADH oxidases from *L. brevis*, *L. lactis*, *S. pneumoniae*, *S. mutans* and *S. hyodysenteriae* in HeLa Tet3G cells. Mean values±S.D. (error bars) from three independent experiments are shown.
Figure 5B:
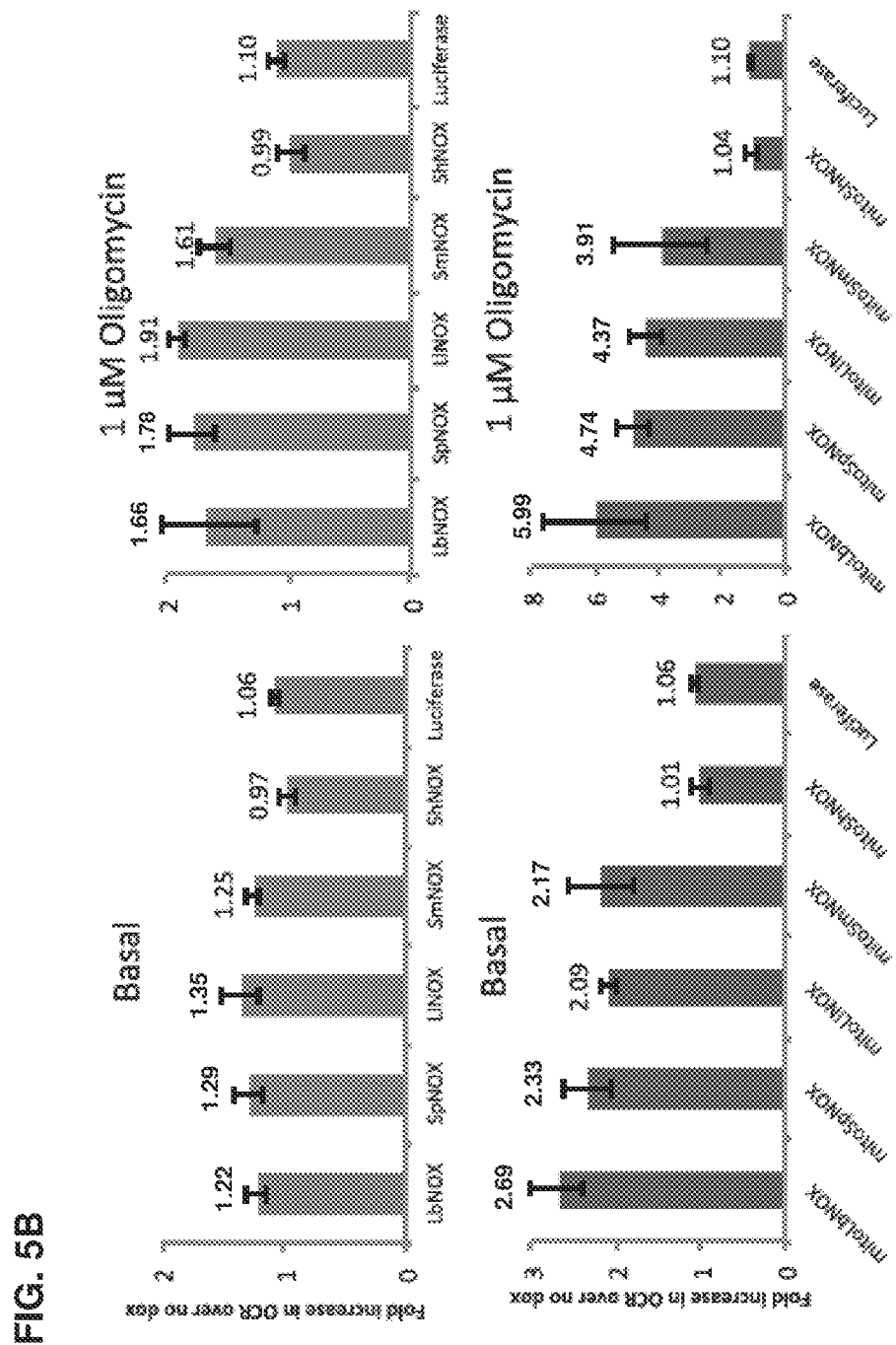
Figure 5B:
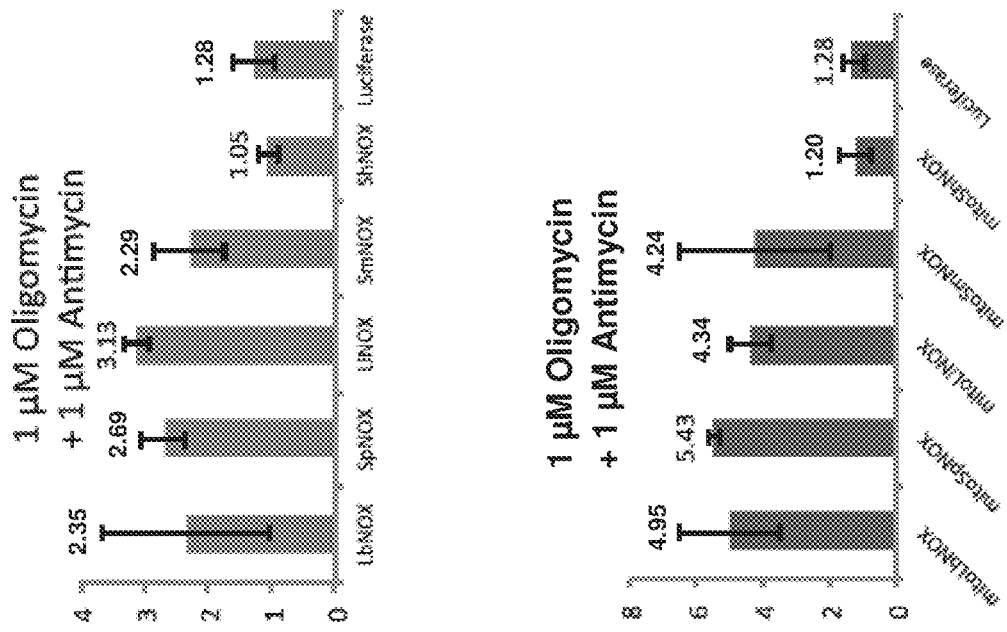

Water-forming NADH or NADPH oxidases (for instance, a water-forming NADH oxidase having the amino acid sequence of any one of SEQ ID NOs: 1-273, such as a water-forming NADH oxidase having the amino acid sequence of any one of SEQ ID NOs: 1-5, or a water-forming NADPH oxidase having the amino acid sequence of SEQ ID NO: 329 or 330) are further capable of increasing the consumption of oxygen when introduced into mammalian cells, including human cells. Expression of these enzymes in mammalian cells results in an increase in oxygen consumption relative to cells of the same type and cultured under similar conditions in the absence of the exogenous water-forming NADH or NADPH oxidase (see, e.g., FIG. 5). For example, the enzymes can increase oxygen consumption in a cell by 1.1-fold to 10-fold (e.g., 1.1-fold, 1.2-fold, 1.3-fold, 1.4-fold, 1.5-fold, 1.6-fold, 1.7-fold, 1.8-fold, 1.9-fold, 2.0-fold, 2.1-fold, 2.2-fold, 2.3-fold, 2.4-fold, 2.5-fold, 2.6-fold, 2.7-fold, 2.8-fold, 2.9-fold, 3.0-fold, 3.5-fold, 4.0-fold, 4.5-fold, 5.0-fold, 5.5-fold, 6.0-fold, 7.0-fold, 8.0-fold, 9.0-fold, and 10.0-fold) relative to a cell lacking the enzyme. In certain cases, a water-forming NADH or NADPH oxidase can increase oxygen consumption in a cell by, e.g., 1.5-10-fold, 1.5-9-fold, 1.5-8-fold, 1.5-7-fold, 1.5-6-fold, 1.5-5-fold, 1.5-4-fold, 1.5-3-fold, or 1.5-2-fold. In alternative cases, a water-forming NADH or NADPH oxidase can increase oxygen consumption in a cell by, e.g., 2-10-fold, 3-10-fold, 4-10-fold, 5-10-fold, 6-10-fold, 7-10-fold, 8-10-fold, or 9-10-fold. In other cases, a water-forming NADH or NADPH oxidase can increase oxygen consumption in a cell by, e.g., 2-9-fold, 3-8-fold, 4-7-fold, or 5-6-fold.

Water-forming NADH or NADPH oxidases for use in the compositions and methods of the invention (for instance, a water-forming NADH oxidase having the amino acid sequence of any one of SEQ ID NOs: 1-273, such as a water-forming NADH oxidase having the amino acid sequence of any one of SEQ ID NOs: 1-5, or a water-forming NADPH oxidase having the amino acid sequence of SEQ ID NO: 329 or 330) are those that are capable of restoring NADH or NADPH to its oxidized state (NAD$^+$ or NADP$^+$), and thus increasing the ratio of NAD$^+$ or NADP$^+$ to NADH or NADPH. Importantly, water-forming NADH or NADPH oxidases do not need to be targeted to a particular sub-cellular organelle in order to restore NAD$^+$ or NADP$^+$ (see, e.g., Examples 3, 4, 6, 7, and 11).

For instance, while water-forming NADH oxidases can be targeted to various organelles, these enzymes are also functional in the cytosol, as they promote such activities as oxygen consumption, gluconeogenesis, and cell growth even when not directed to the mitochondria. In this way, water-forming NADH oxidases are distinct from such proteins as NDI1 and AOX, which must localize to the mitochondria in order to function. Water-forming NADH oxidases are capable of increasing the ratio of NAD$^+$ to NADH in mammalian cells (e.g., human cells) relative to cells of the same type and cultured under similar conditions in the absence of the exogenous water-forming NADH oxidase. For example, the enzymes can increase the ratio of NAD$^+$ to NADH in a cell by 1.1-fold to 10-fold (e.g., 1.1-fold, 1.2-fold, 1.3-fold, 1.4-fold, 1.5-fold, 1.6-fold, 1.7-fold, 1.8-fold, 1.9-fold, 2.0-fold, 2.1-fold, 2.2-fold, 2.3-fold, 2.4-fold, 2.5-fold, 2.6-fold, 2.7-fold, 2.8-fold, 2.9-fold, 3.0-fold, 3.5-fold, 4.0-fold, 4.5-fold, 5.0-fold, 5.5-fold, 6.0-fold, 7.0-fold, 8.0-fold, 9.0-fold, and 10.0-fold) as measured by analysis of NAD$^+$ or NADP$^+$ and NADH or NADPH in cellular extracts relative to a cell lacking the enzyme. In certain cases, a water-forming NADH or NADPH oxidase can increase the ratio of NAD$^+$ to NADH or NADP$^+$ to NADPH in a cell by, e.g., 1.5-10-fold, 1.5-9-fold, 1.5-8-fold, 1.5-7-fold, 1.5-6-fold, 1.5-5-fold, 1.5-4-fold, 1.5-3-fold, or 1.5-2-fold. In some cases, a water-forming NADH oxidase can increase the ratio of NAD$^+$ to NADH in a cell by, e.g., 2-10-fold, 3-10-fold, 4-10-fold, 5-10-fold, 6-10-fold, 7-10-fold, 8-10-fold, or 9-10-fold. In some cases, a water-forming NADH oxidase can increase the ratio of NAD$^+$ to NADH in a cell by, e.g., 2-9-fold, 3-8-fold, 4-7-fold, or 5-6-fold. Stated another way, water-forming NADH oxidases care capable of restoring redox balance in a cell exhibiting an elevated ratio of NADH to NAD$^+$ by oxidizing NADH even in the absence of a functional respiratory chain, thereby lowering the ratio of NADH to NAD$^+$.

For example, water-forming NADH oxidases may lower the intracellular ratio of NADH to NAD$^+$ to between 100:1 and 0.0001:1 (e.g., 100:1, 10:1, 1:1, 0.01:1, 0.001:1, 0.0001:1). Additionally, water-forming NADH oxidases for use in the compositions and methods of the invention are capable of increasing the absolute concentration of NAD$^+$ and lowering the absolute concentration of NADH in the cytoplasm of a mammalian cell (e.g., a human cell) and in specific sub-cellular organelles, such as the mitochondria. For example, water-forming NADH oxidases can increase the absolute concentration of NAD$^+$ in the cytoplasm or in a particular organelle (e.g., the mitochondria) by between 0.001 μM and 1 mM (e.g., by 0.001 μM, 0.01 μM, 0.1 μM, 1 μM, 10 μM, 100 μM, or 1 mM). As such, water-forming NADH oxidases can lower the absolute concentration of NADH in the cytoplasm or in a particular organelle (e.g., the mitochondria) by between, for example, 0.001 μM and 1 mM (e.g., by 0.001 μM, 0.01 μM, 0.1 μM, 1 μM, 10 μM, 100 μM, or 1 mM).

Structural Characteristics of Water-Forming NADH Oxidases

Water-forming NADH oxidases are a product of evolution in lower-order organisms, such as prokaryotes and single-celled eukaryotes, in order to provide a means of regenerating NAD$^+$ in the absence of a respiratory chain. These enzymes are naturally occurring in a wide variety of single-celled organisms and, despite the phylogenetic diversity of these proteins, water-forming NADH oxidases share many important structural features. This molecular similarity is consistent with the principle function of these enzymes, the consumption of oxygen for the restoration of NAD$^+$, which is shared by all water-forming NADH oxidases. Water-forming NADH oxidases for use in the compositions and methods of the invention can be identified based on the presence of one or more (or all) of the following domains: a pyridine nucleotide-disulfide oxidoreductase domain, a thioredoxin domain, an alkyl hydroperoxide domain, and a short-chain dehydrogenase/reductase domain. The structural and functional properties of these domains are described in the sections that follow.

Pyridine Nucleotide-Disulfide Oxidoreductase Domain

There are certain structural domains that are native to water-forming NADH oxidases. These include conserved domains that execute important functions in the catalytic cycle of a water-forming NADH oxidase. For instance, the water-forming NADH oxidases of this invention may contain a pyridine nucleotide-disulfide oxidoreductase domain. This domain contains an NADH-binding site that is located within a larger flavin adenine dinucleotide (FAD) binding pocket. This domain is important for enzymatic activity, since FAD is a cofactor that is used by many water-forming NADH oxidases in the mechanism of NADH oxidation. The sequence of this domain may vary depending on the organism of origin, but these sequences typically exhibit at least 85% sequence identity (e.g., 85%, 90%, 95%, 97%, 99%, or 100% sequence identity) to the representative amino acid sequence of the pyridine nucleotide-disulfide oxidoreductase domain that is provided in SEQ ID NO: 274, derived from *Salmonella enterica*.

Thioredoxin Fold Domain

Water-forming NADH oxidases for use in the compositions and methods of the invention (for instance, a water-forming NADH oxidase having the amino acid sequence of any one of SEQ ID NOs: 1-273, such as a water-forming NADH oxidase having the amino acid sequence of any one of SEQ ID NOs: 1-5) may also contain a thioredoxin (TRX) fold domain, which is derived from the TRX-like protein superfamily. A TRX fold domain may have an amino acid sequence that has at least 85% sequence identity (e.g., 85%, 90%, 95%, 97%, 99%, or 100% sequence identity) to the representative amino acid sequence of SEQ ID NO: 275, derived from *Echinococcus multilocularis*. A TRX fold domain may contain a redox active CXXC sequence, wherein X is any amino acid. The thiol functionality of the flanking cysteine residues is used in the catalytic cycle of enzymes containing this domain, as these moieties can be reversibly oxidized and reduced in order to transfer electrons from a substrate to an oxidizing agent, such as molecular oxygen.

Alkyl Hydroperoxide Reductase F Subunit (AhpF) N-Terminal Domain (NTD)

Water-forming NADH oxidases for use in the compositions and methods of the invention (for instance, a water-forming NADH oxidase having the amino acid sequence of any one of SEQ ID NOs: 1-273, such as a water-forming NADH oxidase having the amino acid sequence of any one of SEQ ID NOs: 1-5) may alternatively contain an alkyl hydroperoxide reductase F subunit (AhpF) N-terminal domain (NTD). This domain is a subdomain within the TRX-fold superfamily. An AhpF N-terminal domain may have an amino acid sequence that has at least 85% sequence identity (e.g., 85%, 90%, 95%, 97%, 99%, or 100% sequence identity) to the representative amino acid sequence of SEQ ID NO: 276, derived from *Lactobacillus fermentum*. AhpF is a homodimeric, FAD-requiring enzyme that catalyzes the reduction of the peroxiredoxin AhpC and the concurrent oxidation of NADH. The N-terminal domain of AhpF contains two continuous TRX-fold subdomains. It may also contain a catalytic core with binding sites for FAD and NADH, as well as an active site disulfide. The postulated catalytic mechanism of enzymes that contain this domain includes a sequential transfer of electrons from NADH to the catalytic core of AhpF and subsequently to the NTD of AhpF, AhpC and ultimately to peroxide substrates. The N-terminal TRX-fold subdomain of AhpF NTD is redox inactive, but is proposed to contain an important residue that aids in the catalytic function of the redox-active CXXC motif contained in the C-terminal TRX-fold subdomain.

Short-Chain Dehydrogenases/Reductases (SDRs)

Water-forming NADH oxidases for use in the compositions and methods of the invention (for instance, a water-forming NADH oxidase having the amino acid sequence of any one of SEQ ID NOs: 1-273, such as a water-forming NADH oxidase having the amino acid sequence of any one of SEQ ID NOs: 1-5) may additionally contain short-chain dehydrogenases/reductase (SDR) domains. A SDR domain may have an amino acid sequence that has at least 85% sequence identity (e.g., 85%, 90%, 95%, 97%, 99%, or 100% sequence identity) to the representative amino acid sequence of SEQ ID NO: 277, derived from *Dinoroseobacter shibae*. SDRs may feature several structural motifs, including a conserved ensemble of alpha helices surrounding a central beta sheet (termed a Rossmann fold) and an NADH-binding site that can also accommodate NADPH. Classical SDRs contain a TGXXX[AG]XG motif (SEQ ID NO: 278) that is used for the binding and recognition of oxidative cofactors, as well as a YXXXK active site motif, wherein the N-terminal tyrosine in this sequence participates in the catalytic mechanism of oxidation. Serine and asparagine residues N-terminal to this active site sequence may also contribute to the oxidative catalysis. The postulated mechanism of the redox reactions catalyzed by this domain proceeds by a hydride transfer from NADH (or NADPH) facilitated by the conserved tyrosine and lysine residues.

Figure 1E:
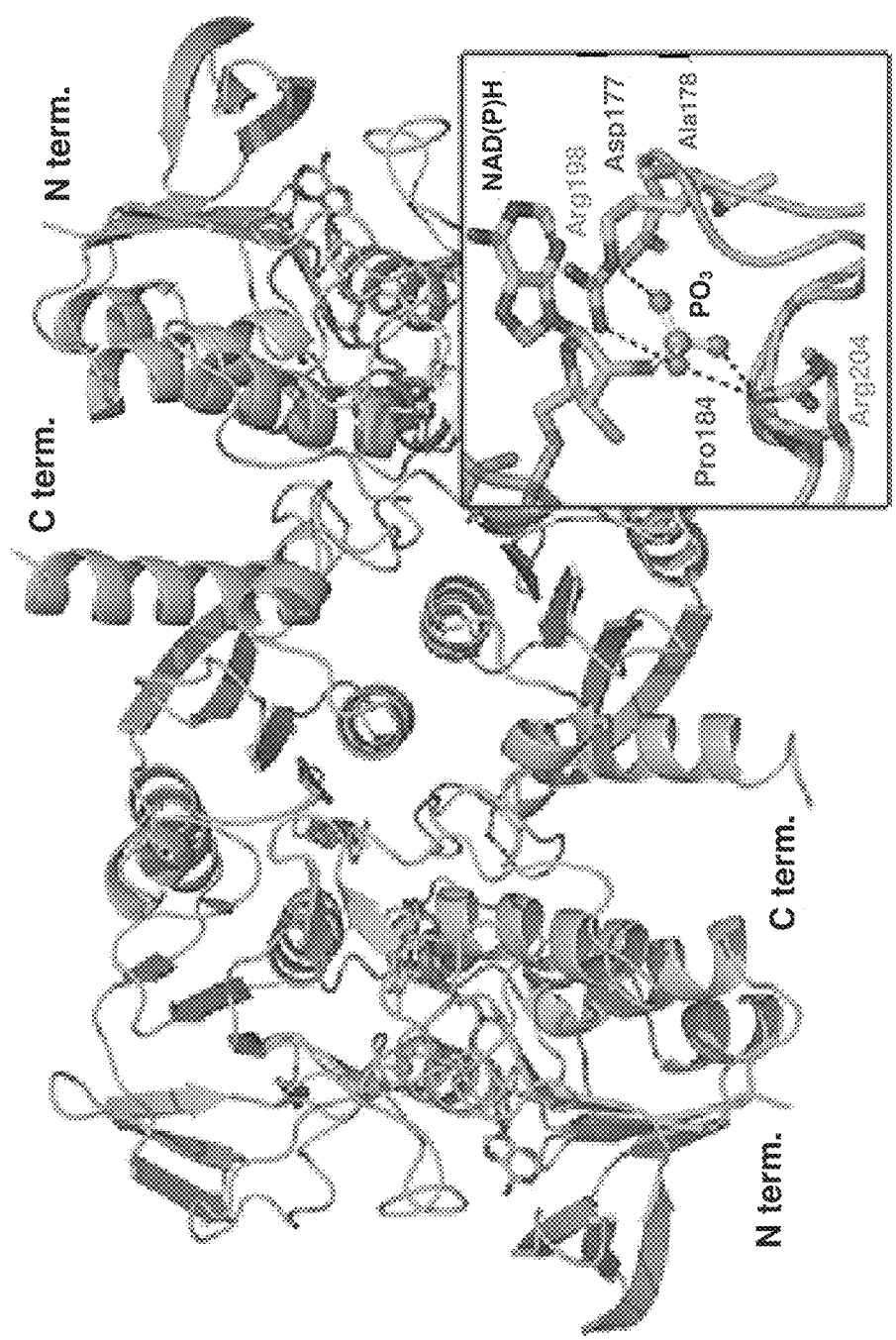

Rational Design of NADH-Specific and NADPH-Specific Water-Forming NADH or NADPH Oxidases The invention is additionally based in part on the discovery of a platform for rationally engineering substrate-selective water-forming NADH or NADPH oxidases. For instance, one can use the sequence of a NADH-specific water-forming NADH oxidase to design a NADPH-specific water-forming NADPH oxidase using this paradigm. As shown in FIG. 1E, the water-forming NADH oxidase of *L. brevis* (LbNOX) contains an aspartic acid residue at amino acid position 177, which is located within the cofactor specificity loop of the enzyme. Removing the anionic substituent and diminishing the steric demand at this and neighboring positions in LbNOX (or equivalent positions in other NADH-specific water-forming NADH oxidases, e.g., as determined by sequence alignment, shown in FIG. 14, or by structural overlay or homology modeling methods known in the art) alleviates repulsive intermolecular interactions between the oxidase and the 2'-phosphate moiety of NADPH. These changes promote the binding of NADPH to the enzyme. This can be done, for instance, by substitution of the aspartic acid residue with an amino acid that is electrostatically neutral at physiological pH and/or that contains a substituent with less steric volume at this position.

NADPH-specific TPNOX was designed by replacing the Asp177 residue of LbNOX with an alanine residue, thereby alleviating steric hindrance to NADPH binding. An arginine substitution was made at positions 178 and 184 of the oxidase. A serine substitution was additionally made at residue 179, which provides a hydrogen bond-donating substituent capable of favorably interacting with the 2'-phosphate of NADPH.

Additionally, the dinucleotide-binding motif of water-forming NADH oxidases can be modified so as to impart these enzymes with altered substrate specificity. For instance, a NADH-specific water-forming NADH oxidase, such as LbNOX, can be converted to a NADPH-specific water-forming NADPH oxidase by incorporating an alanine or serine residue at position 159 of LbNOX, or in an equivalent position in other NADH-specific water-forming NADH oxidases (e.g., as determined by sequence alignment, shown below, or by structural overlay or homology modeling methods known in the art).

Figure 14:
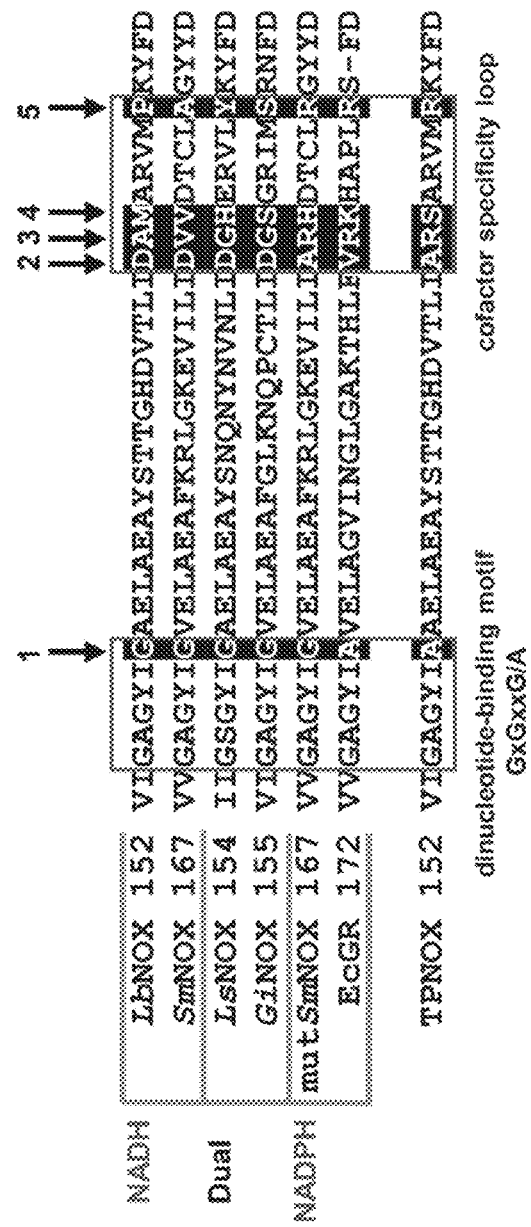
FIG. 14 shows a sequence alignment of enzymes grouped according to their NAD(P)H substrate specificity. The NAD(P)H oxidases (NOXes) are from the following sources (from top to bottom): *L. brevis* ("LbNOX"), *S. mutans* ("SmNOX"), *L. sanfranciscensis* ("LsNOX"), and *G. intestinalis* ("GiNOX"). The glutathione reductase sequence shown is from *E. coli* ("EcGR"). NADPH-specific *S. mutans* NOX is denoted as "mutSmNOX." The positions of amino acid residues of LbNOX that were substituted in the design of an NADPH-specific water-forming NADPH oxidase ("TPNOX") are marked with arrows and numbers. Both the dinucleotide-binding motif and the cofactor specificity loop are boxed on the left side and on the right side of the sequence, respectively. The amino acid substitutions that were made in the design of TPNOX relative to the LbNOX sequence were G159A, D177A, A178R, M179S, and P184R.

This protein design platform can also be used to engineer NADH-specific water-forming NADH oxidases starting from an NADPH-specific water-forming NADPH oxidase. For instance, one can incorporate residues with an anionic side chain at physiological pH, such as aspartic acid and glutamic acid, residues containing sterically hindered sidechains, or residues containing side-chains that lack hydrogen bond donors within the cofactor-specificity loop of a NADH-specific water-forming NADH oxidase to convert the enzyme into a NADPH-specific water-forming NADPH oxidase. Additionally or alternatively, one can impart NADH selectivity to a NADPH-selective water-forming NADPH oxidase by replacing an alanine or serine residue at the position described above in the dinucleotide binding motif with a glycine residue. This restores the GXGXXG dinucleotide-binding motif observed in NADH-specific water-forming NADH oxidases, such as LbNOX and that of *S. mutans* ("SmNOX"), as shown in FIG. 14 and described in Example 11 below.

Sources of Water-Forming NADH and NADPH Oxidases

Water-forming NADH or NADPH oxidases and biologically active fragments thereof for use in the invention can be isolated from several sources, including lower-order organisms, and can be used as therapeutic enzymes in the treatment of human diseases, and as research tools for investigating the function of the respiratory chain. Water-forming NADH or NADPH oxidases for use in the compositions and methods of the invention include, e.g., enzymes that are capable of oxidizing NADH or NADPH to $NAD^+$ or $NADP^+$ and concurrently reducing molecular oxygen to water.

Water-forming NADH or NADPH oxidases include those that are capable of selectively binding and oxidizing NADH and those capable of selectively binding and oxidizing NADPH. Water-forming NADH or NADPH oxidases can be isolated from a wide array of non-mammalian organisms, including, without limitation, bacteria and single-celled eukaryotes. Non-limiting examples of organisms from which the enzymes for use in the compositions and methods of the invention may be isolated include the following species (the sequences of NADH or NADPH oxidases derived therefrom are presented in SEQ ID NOs: 1-273): *Lactobacillus brevis, Lactococcus lactis, Streptococcus pneumoniae, Streptococcus mutans, Serpulina hyodysenteriae, Clostridium aminovalericum, Clostridium bolteae* ATCC BAA-613, *Clostridium scindens* ATCC 35704, *Anaerostipes caccae* DSM 14662, *Bifidobacterium animalis* subsp. *lactis* BB-12, *Bifidobacterium bifidum, Bifidobacterium bifidum* CAG:234, *Bifidobacterium bifidum* PRL2010, *Bifidobacterium breve, Bifidobacterium breve* 12L, *Bifidobacterium breve* 2L, *Bifidobacterium breve* 31L, *Bifidobacterium breve* 689b, *Bifidobacterium breve* JCM 7017, *Bifidobacterium breve* JCM 7019, *Bifidobacterium breve* NCFB 2258, *Bifidobacterium breve* S27, *Bifidobacterium breve* UCC2003, *Enterococcus faecalis* CBRD01, *Lactococcus lactis* subsp. *cremoris* UC509.9, *Lactococcus lactis* subsp. *lactis* KF147, *Oribacterium sinus, Streptococcus equi* subsp. *zooepidemicus* MGCS10565, *Streptococcus infantarius* subsp. *infantarius* ATCC BAA-102, *Streptococcus macedonicus* ACA-DC 198, *Streptococcus mitis, Streptococcus mitis* SK321, *Streptococcus mitis* SK564, *Streptococcus mitis* SK597, *Streptococcus mutans* 11A1, *Streptococcus mutans* 11SSST2, *Streptococcus mutans* 11VS1, *Streptococcus mutans* 14D, *Streptococcus mutans* 15JP3, *Streptococcus mutans* 15VF2, *Streptococcus mutans* 11D3, *Streptococcus mutans* 1SM1, *Streptococcus mutans* 21, *Streptococcus mutans* 24, *Streptococcus mutans* 2ST1, *Streptococcus mutans* 2VS1, *Streptococcus mutans* 3SN1, *Streptococcus mutans* 4SM1, *Streptococcus mutans* 4VF1, *Streptococcus mutans* 5DC8, *Streptococcus mutans* 55M3, *Streptococcus mutans* 66-2A, *Streptococcus mutans* 81D3, *Streptococcus mutans* A19, *Streptococcus mutans* A9, *Streptococcus mutans* AC4446, *Streptococcus mutans* ATCC 25175, *Streptococcus mutans* B, *Streptococcus mutans* G123, *Streptococcus mutans* GS-5, *Streptococcus mutans* KK21, *Streptococcus mutans* KK23, *Streptococcus mutans* LJ23, *Streptococcus mutans* M21, *Streptococcus mutans* M230, *Streptococcus mutans* M2A, *Streptococcus mutans* N29, *Streptococcus mutans* N3209, *Streptococcus mutans* N34, *Streptococcus mutans* N66, *Streptococcus mutans* NCTC 11060, *Streptococcus mutans* NFSM1, *Streptococcus mutans* NFSM2, *Streptococcus mutans* NLML1, *Streptococcus mutans* NLML4, *Streptococcus mutans* NLML5, *Streptococcus mutans* NLML8, *Streptococcus mutans* NLML9, *Streptococcus mutans* NMT4863, *Streptococcus mutans* NN2025, *Streptococcus mutans* NV1996, *Streptococcus mutans* NVAB, *Streptococcus mutans* OMZ175, *Streptococcus mutans* PKUSS-HG01, *Streptococcus mutans* PKUSS-LG01, *Streptococcus mutans* R221, *Streptococcus mutans* S1B, *Streptococcus mutans* SA38, *Streptococcus mutans* SA41, *Streptococcus mutans* SF1, *Streptococcus mutans* SF12, *Streptococcus mutans* SF14, *Streptococcus mutans* SM1, *Streptococcus mutans* SM4, *Streptococcus mutans* SM6, *Streptococcus mutans* ST1, *Streptococcus mutans* ST6, *Streptococcus mutans* T4, *Streptococcus mutans* 0138, *Streptococcus mutans* U2A, *Streptococcus mutans* U2B, *Streptococcus mutans* UA159, *Streptococcus mutans* UA159-FR, *Streptococcus mutans* W6, *Streptococcus oralis, Streptococcus oralis* ATCC 35037, *Streptococcus pneumoniae* 3063-00, *Streptococcus pneumoniae* 4027-06, *Streptococcus pneumoniae* 4075-00, *Streptococcus pneumoniae* 5185-06, *Streptococcus pneumoniae* 5652-06, *Streptococcus pneumoniae* 5787-06, *Streptococcus pneumoniae* 6735-05, *Streptococcus pneumoniae* 6901-05, *Streptococcus pneumoniae* 6963-05, *Streptococcus pneumoniae* 7286-06, *Streptococcus pneumoniae* 7533-05, *Streptococcus pneumoniae* 7879-04, *Streptococcus pneumoniae* 8190-05, *Streptococcus pneumoniae* ECC 3510, *Streptococcus pneumoniae* England14-9, *Streptococcus pneumoniae* EU-NP01, *Streptococcus pneumoniae* EU-NP02, *Streptococcus pneumoniae* EU-NP03, *Streptococcus pneumoniae* EU-NP04, *Streptococcus pneumoniae* EU-NP05, *Streptococcus pneumoniae* GA02254, *Streptococcus pneumoniae* GA02270, *Streptococcus pneumoniae* GA02506, *Streptococcus pneumoniae* GA02714, *Streptococcus pneumoniae* GA04175, *Streptococcus pneumoniae* GA05248, *Streptococcus pneumoniae* GA05578, *Streptococcus pneumoniae* GA06083, *Streptococcus pneumoniae* GA07228, *Streptococcus pneumoniae* GA07643, *Streptococcus pneumoniae* GA07914, *Streptococcus pneumoniae* GA08780, *Streptococcus pneumoniae* GA08825, *Streptococcus pneumoniae* GA11304, *Streptococcus pneumoniae* GA11426, *Streptococcus pneumoniae* GA11856, *Streptococcus pneumoniae* GA13224, *Streptococcus pneumoniae* GA13338, *Streptococcus pneumoniae* GA13430, *Streptococcus pneumoniae* GA13499, *Streptococcus pneumoniae* GA14688, *Streptococcus pneumoniae* GA16531, *Streptococcus pneumoniae* GA17301, *Streptococcus pneumoniae* GA18068, *Streptococcus pneumoniae* GA18523, *Streptococcus pneumoniae* GA19101, *Streptococcus pneumoniae* GA19690, *Streptococcus pneumoniae* GA19923, *Streptococcus pneumoniae* GA40183, *Streptococcus pneumoniae* GA40410, *Streptococcus pneumoniae* GA40563, *Streptococcus pneumoniae* GA41410, *Streptococcus pneumoniae* GA41538, *Streptococcus pneumoniae* GA43257, *Streptococcus pneumoniae* GA43264, *Streptococcus pneumoniae* GA43265, *Streptococcus pneumoniae* GA44128, *Streptococcus pneumoniae* GA44194, *Streptococcus pneumoniae* GA44288, *Streptococcus pneumoniae* GA44378, *Streptococcus pneumoniae* GA44386, *Streptococcus pneumoniae* GA44452, *Streptococcus pneumoniae* GA44500, *Streptococcus pneumoniae* GA44511, *Streptococcus pneumoniae* GA47033, *Streptococcus pneumoniae* GA47179, *Streptococcus pneumoniae* GA47210, *Streptococcus pneumoniae* GA47281, *Streptococcus pneumoniae* GA47360, *Streptococcus pneumoniae* GA47373, *Streptococcus pneumoniae* GA47388, *Streptococcus pneumoniae* GA47439, *Streptococcus pneumoniae* GA47461, *Streptococcus pneumoniae* GA47502, *Streptococcus pneumoniae* GA47522, *Streptococcus pneumoniae* GA47597, *Streptococcus pneumoniae* GA47628, *Streptococcus pneumoniae* GA47751, *Streptococcus pneumoniae* GA47760, *Streptococcus pneumoniae* GA47976, *Streptococcus pneumoniae* GA49138, *Streptococcus pneumoniae* GA49194, *Streptococcus pneumoniae* GA49447, *Streptococcus pneumoniae* GA49542, *Streptococcus pneumoniae* GA52612, *Streptococcus pneumoniae* GA54644, *Streptococcus pneumoniae* NorthCarolina6A-23, *Streptococcus pneumoniae* NP070, *Streptococcus pneumoniae* NP112, *Streptococcus pneumoniae* NP127, *Streptococcus pneumoniae* NP141, *Streptococcus pneumoniae* NP170, *Streptococcus pneumoniae* SPAR27, *Streptococcus pneumoniae* SPAR48, *Streptococcus pneumoniae* SPAR55, *Streptococcus pneumoniae* SPAR95, *Streptococcus pyogenes, Streptococcus pyogenes* A20, *Streptococcus pyogenes* AA216, *Streptococcus pyogenes* AA472, *Streptococcus pyogenes* Alab49, *Streptococ-* cus pyogenes HKU QMH11M0907901, *Streptococcus pyogenes* JRS4, *Streptococcus pyogenes* M1 476, *Streptococcus pyogenes* M1 GAS, *Streptococcus pyogenes* MGAS10270, *Streptococcus pyogenes* MGAS10394, *Streptococcus pyogenes* MGAS10750, *Streptococcus pyogenes* MGAS2096, *Streptococcus pyogenes* MGAS2111, *Streptococcus pyogenes* MGAS5005, *Streptococcus pyogenes* MGAS6180, *Streptococcus pyogenes* MGAS9429, *Streptococcus pyogenes* SS1447, *Streptococcus ratti* FA-1=DSM 20564, *Streptococcus salivarius* K12, *Streptococcus sinensis*, *Streptococcus* sp. HSISB1, *Streptococcus* sp. HSISS1, *Streptococcus* sp. HSISS4, *Streptococcus thermophilus*, *Streptococcus thermophilus* CAG:236, *Streptococcus thermophilus* CNRZ1066, *Streptococcus thermophilus* JIM 8232, *Streptococcus thermophilus* LMG 18311, *Streptococcus thermophilus* MN-ZLW-002, *Streptococcus thermophilus* MTCC 5460, *Streptococcus thermophilus* MTCC 5461, *Streptococcus thermophilus* ND03, *Aeromonas hydrophila* 4AK4, *Aeromonas media* WS, *Aeromonas salmonicida* subsp. *salmonicida* A449, *Aeromonas veronii* 8565, *Bacillus cereus* G9241, *Borrelia afzelii* PKo, *Borrelia crocidurae* str. Achema, *Borrelia duttonii* Ly, *Borrelia garinii* PBi, *Borrelia recurrentis* A1, *Intestinibacter bartlettii* DSM 16795, *Lactobacillus Sanfranciscensis*, *Lactococcus lactis* subsp. *cremoris*, *Lactococcus lactis* subsp. *cremoris* MG1363, *Leptotrichia hofstadii* F0254, *Streptococcus agalactiae* A909, *Streptococcus agalactiae* CF01173, *Streptococcus agalactiae* FSL S3-026, *Streptococcus agalactiae* GB00112, *Streptococcus agalactiae* SS1014, *Streptococcus agalactiae* STIR-CD-17, *Streptococcus agalactiae* Z00910, *Vibrio campbellii* HY01, *Clostridium aminovalericum* NRIC0223, *Lactobacillus rhamnosus*, *Lactobacillus rhamnosus* ATCC 53103, *Lactococcus lactis* MG1363, *Streptococcus agalactiae*, *Streptococcus mutans* NCBI 11723, *Enterococcus faecalis*, *Giardia lamblia*, *Giardia intestinalis*, *Trichomonas vaginalis*, and *Synechocystis* sp. Water-forming NADH oxidases for use in the compositions and methods of the invention also include those derived from eukaryotic organisms, as well as enzymes that utilize cofactors other than FAD, such as flavodiiron proteins. Additional examples of water-forming NADH oxidases the can be used in the compositions and methods of the invention are provided in Tables 1 and 2 below:

TABLE 1

Exemplary water-forming NADH oxidases derived from eukaryotic organisms

| Organism | Protein name | GenBank Accession # | SEQ ID NO. |
|---|---|---|---|
| *Giardia lamblia* | NADH oxidase lateral transfer candidate | XP_001707974.1 | 266 |
| *Giardia lamblia* | NADH oxidase lateral transfer candidate | EFO61859.1 | 267 |
| *Giardia intestinalis* | NADH oxidase lateral transfer candidate | EET00402.1 | 268 |

TABLE 2

Exemplary water-forming NADH oxidases that utilize a cofactor other than FAD

| Organism | Protein name in the database | GenBank Accession # | SEQ ID NO. |
|---|---|---|---|
| *Trichomonas vaginalis* | Pyridine nucleotide-disulphide oxidoreductase family protein | XP_001317833.1 | 269 |
| *Trichomonas vaginalis* | Pyridine nucleotide-disulphide oxidoreductase family protein | XP_001315422.1 | 270 |
| *Trichomonas vaginalis* | Pyridine nucleotide-disulphide oxidoreductase family protein | XP_001322980.1 | 271 |
| *Synechocystis* sp. | Diflavin flavoprotein A 1 | WP_010873710.1 | 272 |
| *Synechocystis* sp. | DeoR family transcriptional regulator | WP_010871360.1 | 273 |

Examples of water-forming NADH oxidases from the organisms described above that can be used in the compositions and methods of the invention include those that have at least 85% sequence identity (e.g., 85%, 90%, 95%, 97%, 99%, or 100% sequence identity) to the sequence of any one of SEQ ID NOs: 1-273 and biologically active fragments thereof.

NADPH-specific water-forming NADPH oxidases can be isolated, for instance, from *S. mutans* (SEQ ID NO: 330). NADPH-specific water-forming NADPH oxidases may also be rationally designed, for instance, using procedures described herein. A representative rationally-designed NADPH-specific water-forming NADPH oxidase is TPNOX (SEQ ID NO: 329), the design of which is described in Example 11 below.

Water-Forming NADH Oxidase Derived from *Lactobacillus brevis*

Figure 6:
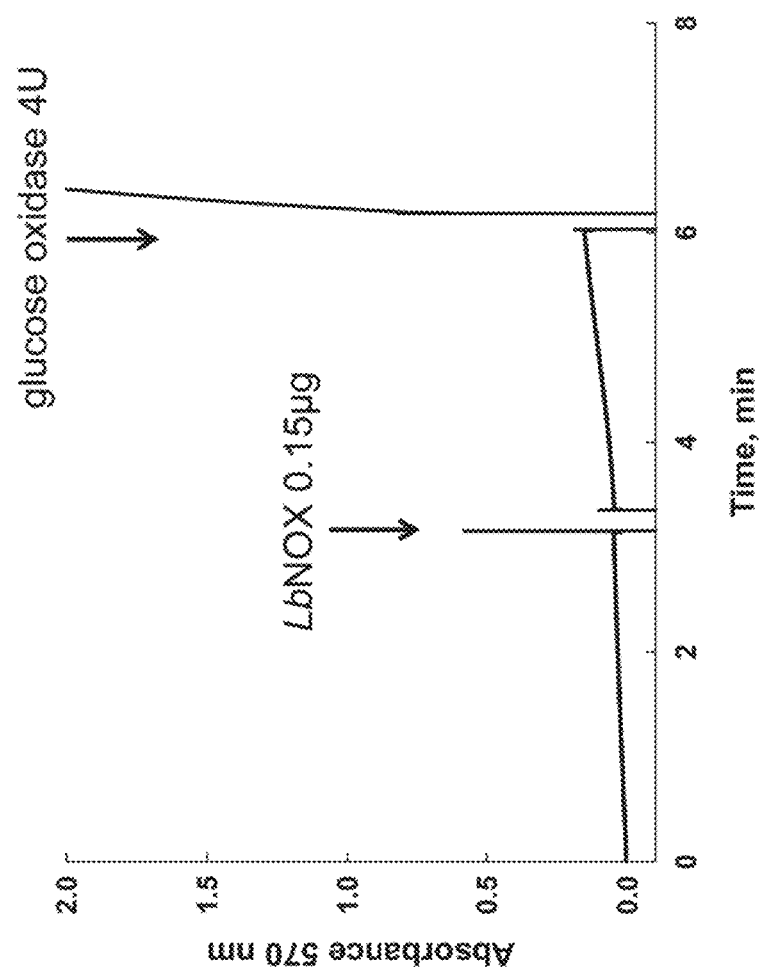
FIG. 6 shows the results of a continuous assay to monitor $H_2O_2$-production by LbNOX. Reaction mixture contained: 50 mM NaPi pH 7.5, 150 mM NaCl buffer, 350 µM NADH, SOD 130U and 100 µM D-glucose at 37° C. At times indicated LbNOX and glucose oxidase were added. Glucose oxidase was used to validate the assay, since this enzyme produces $H_2O_2$ from oxygen and D-glucose. Rates on $H_2O_2$-forming activity of LbNOX were compared to rates of NADH disappearance in parallel experiments. It was estimated that around 1.7±0.3% of $H_2O_2$ is produced by LbNOX (n=4).

The water-forming NADH oxidases, as well as biologically active fragments thereof that maintain enzymatic activity, for use in the compositions and methods of the invention exhibit catalytic properties that render these enzymes well-suited for therapeutic application in patients suffering from diseases associated with deficiencies in the mitochondrial respiratory chain. One particular enzyme for use in the compositions and methods of the invention that exhibits exemplary biochemical properties is the water-forming NADH oxidase that is endogenous to *Lactobacillus brevis*. This oxidase (hereinafter "LbNOX") is of particular interest given its reactivity with NADH and molecular oxygen at biologically relevant concentrations of these substrates, as well as the ability of this enzyme to restrict hydrogen peroxide production to a minimal amount. LbNOX exhibits an apparent $K_M$ for NADH of 69 µM and an apparent $K_M$ for $O_2$ of below 2 µM (~0.17% $O_2$) as estimated from enzyme-monitored turnover experiments (FIG. 7), which is more than 10-fold lower than the concentration of oxygen in human venous blood. Moreover, LbNOX produces less than 1-2% by mole of $H_2O_2$ relative to $H_2O$ production during its catalytic cycle (FIG. 6). The high affinity of LbNOX for molecular oxygen, coupled with the surprisingly low production of $H_2O_2$, makes this enzyme well-suited for potential therapeutic applications in mammalian tissues.

In view of these beneficial properties, water-forming NADH oxidases can be administered to a patient to compensate for a defective respiratory chain in mammalian cells, particularly in human cells. The inability of a defective respiratory chain to produce ATP has long been considered an underlying etiology for diseases that have been correlated with mitochondrial dysfunction. Yet, many problematic phenotypes associated with these diseases, such as stalled glucose metabolism and nucleotide biosynthesis, can be overcome by introducing an exogenous water-forming NADH oxidase, such as one or more of those described herein, to a mammalian cell harboring a defective respiratory chain. The pathophysiology of many mitochondrial diseases can in fact be attributed to the inability of the cell to regenerate $NAD^+$, a problem that can be readily addressed by administration of water-forming NADH oxidases according to the methods of the invention.

Methods of Treating Mammalian Diseases and Conditions

Mitochondrial disorders represent one of the most common and challenging classes of inborn errors of metabolism. Symptoms arise in infancy or in adulthood and typically impact multiple organ systems. Manifestations may include lactic acidosis, seizures, stroke-like episodes, gray or white matter disease, neurodegeneration, autonomic dysfunction, cardiac conduction defects, cardiomyopathy, pancreatic exocrine or endocrine dysfunction, skeletal muscle myopathy, peripheral neuropathy, blindness, gastrointestinal dysmotility, deafness, and liver and kidney failure. Over 150 nuclear genome encoded disease genes have been identified, and over 100 mtDNA mutations in mitochondrial DNA (mtDNA) have been identified. All of these disorders are characterized by a biochemical defect within the mitochondrial respiratory chain or in the ATP synthase (complex V). However, these disorders continue to pose great clinical challenges: they are difficult to diagnose due to their phenotypic and genetic heterogeneity, and no proven therapies currently exist. It is also less likely that the pharmaceutical industry will pursue these disorders since they represent a large collection of individually rare genetic syndromes, each affecting only a few hundred patients. This invention provides a new therapeutic paradigm by targeting a unifying common cause in all of these disorders: a blockade in the respiratory chain.

Water-forming NADH or NADPH oxidases (for instance, a water-forming NADH oxidase having the amino acid sequence of any one of SEQ ID NOs: 1-273 and variants thereof described herein, such as a water-forming NADH oxidase having the amino acid sequence of any one of SEQ ID NOs: 1-5, or a water-forming NADPH oxidase having the amino acid sequence of SEQ ID NO: 329 or 330 and variants thereof described herein), as well as biologically active fragments thereof that maintain enzymatic activity, can be administered to a patient (e.g., a human patient) suffering from a disease associated with an elevated NADH to $NAD^+$ ratio or an elevated NADPH to $NADP^+$ ratio. In order to assess whether a patient is in need of such treatment, a physician may analyze the ratio of NADH to $NAD^+$ or NADPH to $NADP^+$ within one or more cells of a patient. For instance, one may analyze the ratio of NADH to $NAD^+$ or NADPH to $NADP^+$ in the cytoplasm or mitochondria of one or more cells of a patient (e.g., according to the methods described herein or known in the field). In these instances, an elevated ratio of $NADH:NAD^+$ or $NADPH:NADP^+$ relative to that of a healthy human indicates a patient may be suffering from reductive stress and can be treated by administration of a water-forming NADH or NADPH oxidase or a biologically active fragment thereof. In other cases, a physician may analyze the ratio of $NAD^+$ to NADH or $NADP^+$ to NADPH in one or more cells (e.g., in the cytoplasm or mitochondria of these cells) of a patient. In these instances, a reduced ratio of $NAD^+:NADH$ or $NADP^+:$NADPH relative to that of a healthy human indicates a patient may be suffering from reductive stress and can be treated by administration of a water-forming NADH or NADPH oxidase or a biologically active fragment thereof.

Examples of diseases that can be treated by administration of a water-forming NADH or NADPH oxidase or biologically active fragment thereof, such as those described herein, include any disorder that is associated with a defect in a component of the mitochondrial respiratory chain, such as complexes I through IV of the respiratory chain. Examples of such diseases include, without limitation, mitochondrial myopathy, Wolff-Parkinsons-White syndrome, neuropathy, ataxia, Friedreich's ataxia, retinitis pigmentosa, and ptosis (NARP), myoneurogenic gastrointestinal encephalopathy (MNGIE), myoclonic epilepsy with ragged red fibers (MERRF), mitochondrial encephalomyopathy, lactic acidosis, and stroke-like symptoms (MELAS), mitochondrial DNA depletion, chronic progressive external ophthalmoplegia, Kearns-Sayre syndrome, Leber hereditary optic neuropathy, mitochondrial encephalomyopathy, myoclonic epilepsy, myopathy, and sensory ataxia (MEMSA), myoclonic epilepsy, mitochondrial recessive ataxia syndrome, sensory ataxia neuropathy, dysarthria, ophthalmoplegia, and spinocerebellar ataxia, sarcopenia, and skeletal muscle atrophy. Water-forming NADH or NADPH oxidases, such as those described herein, can be administered to patients suffering from these disorders in order to stimulate $NAD^+$ and/or $NADP^+$ regeneration, which has stalled in these patients due to a malfunction of the respiratory chain.

Water-forming NADH or NADPH oxidases, such as those described herein, are also useful in the treatment of neurodegenerative diseases, such as Parkinson's disease. This disease has been correlated with the onset of oxidative stress due to elevated NADH levels caused by a deficiency in complex I and complex III activity, often due to mutations in one or more genes that encode one or more proteins of these complexes (Konstanze, et al., *Biochim. Biophys. Acta Mol. Bas. Dis.*, 1802:29-44, 2010), due to environmental toxins that cause Parkinsons disease, or by other mechanisms. Water-forming NADH or NADPH oxidases and biologically active fragments thereof that maintain enzymatic activity can therefore be administered to a patient to treat this disorder, as these enzymes can enable NADH to bypass the respiratory chain altogether to get oxidized, regardless of the constituent proteins that are defective in a given patient.

In light of the ability of these enzymes to modulate gluconeogenesis and provide $NAD^+$ that is necessary for glucose catabolism, water-forming NADH or NADPH oxidases and biologically active fragments thereof that maintain enzymatic activity, such as those described herein, can also be administered to patients suffering from a glucose metabolism disorder. Patients that may be amenable to such treatment include those suffering from type I or type II diabetes, as well as obesity. Water-forming NADH or NADPH oxidases can be administered to such patients in order to restore glucose uptake and glycolysis, a process that is contingent upon a sufficient cytosolic supply of $NAD^+$. In addition, water-forming NADH or NADPH oxidases catalyze an exergonic redox reaction in which heat is released due to the reduction of molecular oxygen (the NADH oxidation and oxygen reduction process is characterized by an electromotive force of approximately 1.14 V per mole of NADH under standard, physiological conditions). The burning of calories that occurs during this process is another means by which these enzymes may be used to treat such disorders as obesity and diabetes.

Aging is another condition that can be treated using water-forming NADH or NADPH oxidases and biologically active fragments thereof that maintain enzymatic activity. At the cellular level, aging is a progressive decline in the ability of a cell to respond to stress, resulting in loss of vital metabolic activity and ultimately cell death. Reductive stress imposed by an elevated NADH to $NAD^+$ ratio can lead to the production of reactive oxygen species (ROS), such as superoxide ($O_2^-$) or hydrogen peroxide. These molecules are highly reactive and can induce damage in essential biomolecules, including proteins and DNA. Specific examples of ROS-induced chemical harm include the oxidation of amino acids in proteins, the cleavage of nucleic acids, and the oxidation of lipids. The totality of this damage results in loss of critical cellular functions and is associated with the aging process. The administration of water-forming NADH or NADPH oxidases according to the invention can help to mitigate the aging process (e.g., slow this process or lessen the damaging effects caused by reductive stress) by diminishing the NADH to $NAD^+$ ratio so as to prevent the formation of reactive oxygen species.

ROS-induced oxidative damage at the molecular level can produce a variety of symptoms that are associated with the aging process. These symptoms vary with the precise location of oxidative stress within the body. For instance, age-associated oxidative stress has been correlated with certain cardiac conditions, including a thickening of the walls of the heart, a decline in efficiency of cardiomyocyte activity, a reduction in flexibility of the aorta, and in certain cases one may experience a gradual onset of atherosclerosis. Additionally, oxidative stress that accompanies aging induces digestive difficulties, including a reduction in the secretion of digestive enzymes by the stomach, liver, pancreas, and small intestine, as well as a decline in the rate at which food progresses through the gastrointestinal tract. Aging has also been correlated with a weakening of cartilage, muscle, and bone. In certain cases, one may experience a stiffening of the retina, a decline in clarity of the ocular lenses, and a thickening of the eardrums. The growth of hair and nails has been shown to slow as aging progresses, and skin progressively loses thickness and elasticity. Additional indications of aging include, for example, increased susceptibility to infection, greater risk of heat stroke or hypothermia, a reduction in height as bone mass declines, stooped posture, slowed and limited movement, lethargy, urinary incontinence, slowing of thought and memory recall, reduced physical coordination, diminished visual acuity, decline in peripheral vision, hearing loss, graying or whitening of the hair, weight loss, and stooped posture. Water-forming NADH or NADPH oxidases and biologically active fragments thereof that maintain enzymatic activity, such as those described herein, are capable of depleting intracellular NADH and NADPH, thereby inducing a shift in redox equilibria away from the formation of peroxides and other reactive oxygen species. Since the accumulation of these molecules and the chemical degradation they effect has been correlated with the aging process, water-forming NADH or NADPH oxidases can be administered according to the methods of the invention to a patient in order to treat one or more symptoms associated with aging, such as those listed above.

A water-forming NADH or NADPH oxidase (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) or a biologically active fragment thereof that maintains enzymatic activity can also be administered to a patient (e.g., a human patient) suffering from cancer in order to improve the condition of such patients. Oxidative stress induced by an elevated NADH to $NAD^+$ ratio has been shown to activate a variety of transcription factors, including NF-κB, AP-1, p53, HIF-1α, PPAR-γ, β-catenin/Wnt, and Nrf2. The aberrant activation of these transcription factors can engender the expression of over 500 different genes, including those for growth factors, inflammatory cytokines, chemokines, cell cycle regulatory molecules, and anti-inflammatory molecules (Reuter, et al., *Free Radic. Biol. Med.*, 49:1603-1616, 2010). Moreover, elevated levels of ROS lead to mutations in important genes that control cell cycle progression, and these mutations have been correlated with the onset of a variety of cancers (Muller, et al., Eur. J. Biochem., 244:45-52, 1997). By administering a water-forming NADH or NADPH oxidase, such as those described herein, to a patient suffering from cancer or a disease associated with aberrant cell cycle regulation, the intracellular level of NADH relative to $NAD^+$ can be lowered, thus restoring redox balance and preventing ROS-induced DNA damage. Examples of cancers that can be treated with a water-forming NADH or NADPH oxidase include, without limitation, breast cancer, paraganglioma, phaeochromocytoma, leiomyoma, leiomyosarcoma, and renal cell carcinoma.

Water-forming NADH or NADPH oxidases (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) and biologically active fragments thereof that maintain enzymatic activity may also provide relief from the symptoms of a mitochondrial disorder. Patients presenting with one or more of such diseases often exhibit any of a variety of symptoms due to dysfunctional respiratory chain activity in one or more organs. For instance, deficient mitochondrial function in the brain can cause dementia, neuro-psychiatric disturbances, migraines, seizures, strokes, atypical cerebral palsy, mental retardation, autistic features, and developmental delays. Insufficient neuronal respiratory chain activity has been correlated with weakness, absent reflexes, fainting, neuropathic pain, and internal temperature instability. Muscular respiratory chain deficiencies are often associated with cramping, gastrointestinal pain, dysmotility, irritable bowel syndrome, hypotonia, muscle pain, gastroesophageal reflux, diarrhea, constipation, and intestinal pseudo-obstruction (inability of the intestine to move food, stool, or air through the gastrointestinal tract). In the kidneys, lack of mitochondrial respiratory chain activity can cause renal tubular acidosis. Insufficient cardiac mitochondrial activity may lead to cardiac conduction defects and cardiomyopathy. Liver mitochondrial defects can cause hypoglycemia and potential liver failure. Dysfunctional respiratory chain activity in the eyes and ears can lead to visual loss, blindness, ptosis, ophthalmoplegia, optic atrophy, hearing loss, deafness, acquired strabismus, and retinitis pigmentosa. Additional symptoms may include exocrine pancreatic failure due to mitochondrial dysfunction in the pancreas, as well as fatigue, failure to gain weight, vomiting, and respiratory sickness as a result of systemic deficiencies in mitochondrial activity. In this way, water-forming NADH or NADPH oxidases, when administered according to methods of the invention, can provide a two-fold paradigm for treating mitochondrial disease. These enzymes can be administered to patients on a long-term basis (e.g., over the course of days, weeks, months, years, etc.) to promote continuous redox balance and thus ameliorate a mitochondrial disorder over the course of a patient's lifetime. In addition, water-forming NADH or NADPH oxidases represent a novel short-term therapy that can be administered to a patient to alleviate one or more symptoms of mitochondrial dysfunction, such as those described above.

Treatment of the diseases, conditions, and symptoms of mitochondrial disorders (e.g., as described herein) by administration of water-forming NADH or NADPH oxidases and biologically active fragments thereof that maintain enzymatic activity, such as those described herein, can improve the condition of a patient over the course of such treatment. The condition of a patient that receives treatment by administration of water-forming NADH or NADPH oxidases can be monitored by any of a variety of different strategies. For example, a patient undergoing treatment with these therapeutic enzymes can be monitored by routine observation by a physician for a change in the frequency or severity of one or more symptoms associated with a mitochondrial disease (e.g., one of the symptoms described above). Optionally, cells can be extracted from the patient in order to conduct a biochemical analysis of the relative levels of metabolites and cofactors within the cells or within specific organelles of these cells. For instance, cells of a patient can be extracted and the intracellular concentrations of $NAD^+$ and NADH or $NADP^+$ and NADPH can be determined in order to analyze the response of the patient to treatment with water-forming NADH or NADPH oxidases. It may optionally be desirable for a physician to monitor the progression of a disease or condition in a patient by analyzing a bodily fluid sample. For instance, a physician may withdraw blood from a patient undergoing therapy in order to determine the concentration of one or more proteins, metabolites, or nutrients in the sample to evaluate the response of the patient to treatment with water-forming NADH or NADPH oxidases. In certain cases, it may be desirable to monitor the dissolved oxygen content within a blood sample in order to determine the effectiveness of the therapy, as water-forming NADH or NADPH oxidases are capable of increasing the rate of oxygen consumption in mammalian cells and may therefore modulate the oxygenation state of red blood cells. Optionally, a physician may monitor the progression of a disease or condition in a patient undergoing water-forming NADH or NADPH oxidase therapy by analyzing a urine sample, e.g., by determining the concentration of dissolved metabolites or nutrients, such as lactate. This may be desirable so as to monitor the progression of a glucose metabolism disorder, such as diabetes, since the excretion of glucose into the urine due to the inability of the kidneys to retain glucose is an indication of this disease. Examples of other bodily fluids that may be analyzed so as to monitor a patient undergoing treatment by administration of the compositions of the invention, e.g., water-forming NADH or NADPH oxidases, polynucleotides encoding water-forming NADH or NADPH oxidases, vectors containing these polynucleotides, a mammalian cell expressing a water-forming NADH or NADPH oxidase, etc., include aqueous humor, cerebrospinal fluid, endolymph, perilymph, mucus, pericardial fluid, peritoneal fluid, saliva, sebumen, semen, sweat, and tears, among others.

In order to treat the diseases or conditions described herein, one may administer a water-forming NADH or NADPH oxidase or a biologically active fragment thereof that maintains enzymatic activity, such as those described herein, to a patient in need thereof. This can be done by, for example, administering a human cell that has been engineered so as to express a water-forming NADH or NADPH oxidase to a patient presenting with one or more of these disorders. In this way, for instance, the tissue system or organ that is adversely affected by a dysfunctional respiratory chain can regenerate $NAD^+$ and restore proper redox balance. Human cells can be modified in order to express water-forming NADH or NADPH oxidases, for example, by any of the methods or techniques described herein, in order to provide a patient with a continuous supply of cells containing these enzymes. For instance, a human cell that has been modified such that a polynucleotide encoding a water-forming NADH or NADPH oxidase has been covalently inserted into the nuclear DNA of the cell can be administered to a patient in order to treat a mitochondrial disease. Not only can these cells achieve short-term relief from the disorder, for instance, by regenerating $NAD^+$ or $NADP^+$ at sites of reductive stress, this treatment regimen may also provide a longer-term supply of water-forming NADH or NADPH oxidases, as the administered cell can proliferate in vivo, giving rise to daughter cells that contain these enzymes. This proliferation can continue so as to produce a population of cells that express water-forming NADH or NADPH oxidases and may therefore provide continuous relief from the effects of a dysfunctional respiratory chain.

In addition to this treatment paradigm, water-forming NADH or NADPH oxidases and biologically active fragments thereof that maintain enzymatic activity can be administered to a patient by a variety of other mechanisms. For instance, a polynucleotide encoding the enzyme can be administered to a patient. A polynucleotide encoding the enzyme can be administered to a patient, e.g., in the form of a vector. If desired, the vector may be one that integrates the polynucleotide into the genome of the patient. A water-forming NADH or NADPH oxidase can alternatively be administered as a therapeutic protein directly to a patient, and a variety of strategies have been developed for administration of whole proteins that can be used to facilitate delivery of these enzymes to the appropriate cellular target. The sections that follow describe in further detail the methods by which water-forming NADH or NADPH oxidases may be administered to a patient, particularly to a mammalian patient, and most preferably to a human patient, suffering from a disease associated with an elevated NADH to $NAD^+$ ratio and/or an elevated NADPH to $NADP^+$ ratio.

Expression of Water-Forming NADH or NADPH Oxidases in Mammalian Cells

The water-forming NADH or NADPH oxidases of the invention can be derived from microbial organisms that have evolved single enzymes that perform the NADH or NADPH oxidation and concomitant reduction of molecular oxygen to water that is generally performed by the mitochondrial respiratory chain in mammalian cells. Such single-protein, water-forming NADH or NADPH oxidases are not naturally occurring in the mammalian proteome. Because of their singular nature, these enzymes represent an attractive paradigm for targeting mammalian diseases, particularly those that are associated with elevated $NADH/NAD^+$ ratios. In order to utilize these enzymes for therapeutic application in the restoration of intracellular $NAD^+$, these enzymes can be directed to the interior of the cell, and in particular instances, to particular organelles. A wide array of methods has been established for the delivery of such proteins to mammalian cells and for the stable expression of genes encoding such proteins in mammalian cells.

Polynucleotides Encoding Water-Forming NADH or NADPH Oxidases

One platform that can be used to achieve therapeutically effective intracellular concentrations of water-forming NADH or NADPH oxidases (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) in mammalian cells is via the stable expression of genes encoding these enzymes (e.g., by integration into the nuclear or mitochondrial genome of a mammalian cell). These genes are polynucleotides that encode the primary amino acid sequence of the corresponding protein. In order to introduce such exogenous genes into a mammalian cell, these genes can be incorporated into a vector. Vectors can be introduced into a cell by a variety of methods, including transformation, transfection, direct uptake, projectile bombardment, and by encapsulation of the vector in a liposomes. Examples of suitable methods of transfecting or transforming cells include calcium phosphate precipitation, electroporation, microinjection, infection, lipofection and direct uptake. Such methods are described in more detail, for example, in Sambrook et al., *Molecular Cloning: A Laboratory Manual*, Second Edition, Cold Spring Harbor University Press, New York (1989) and Ausubel, et al., *Current Protocols in Molecular Biology*, John Wiley & Sons, New York (1998), the teachings of which are incorporated herein by reference.

Water-forming NADH or NADPH oxidases (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) can also be introduced into a mammalian cell by targeting a vector containing a gene encoding such an enzyme to cell membrane phospholipids. For example, vectors can be targeted to the phospholipids on the extracellular surface of the cell membrane by linking the vector molecule to a VSV-G protein, a viral protein with affinity for all cell membrane phospholipids. Such a construct can be produced using methods well known to those of skill in the field.

Recognition and binding of the polynucleotide encoding a water-forming NADH or NADPH oxidase by mammalian RNA polymerase is important for gene expression. As such, one may include sequence elements within the polynucleotide that exhibit a high affinity for transcription factors that recruit RNA polymerase and promote the assembly of the transcription complex at the transcription initiation site. Such sequence elements include, e.g., a mammalian promoter, the sequence of which can be recognized and bound by specific transcription initiation factors and ultimately RNA polymerase. Examples of mammalian promoters have been described in Smith, et al., Mol. Sys. Biol., 3:73, online publication, the teachings of which are incorporated by reference herein.

Polynucleotides of this invention also include those that encode a water-forming NADH or NADPH oxidase (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) downstream of a mammalian promoter. Promoters that are useful for the expression of water-forming NADH or NADPH oxidases in mammalian cells include, e.g., albumin promoter, apolipoprotein promoter, cycloexegnase-2 promoter, cyclooxygenase-5B promoter, acyl-CoA oxidase promoter, glycerol-3-phosphate dehydrogenase promoter, xanthine dehydrogenase promoter, lysyl oxidase-like 3 promoter, intercellular adhesion molecule 5 promoter, succinate dehydrogenase complex promoters (e.g., subunit A flavoprotein), molybdenum cofactor synthesis 1 promoter, D-aspartate oxidase promoter, NADPH oxidase 3 promoter, elongator acetyltransferase complex subunit 3 promoter, sarcosine dehydrogenase promoter, polyamine oxidase promoter, ferritin heavy polypeptide 1 promoter, dual oxidase maturation factor 1 promoter, methallothionein promoter, β-actin promoter, human hemoglobin promoter, and human muscle creatine promoter. Alternatively, promoters derived from viral genomes can also be used for the stable expression of these enzymes in mammalian cells. Examples of functional viral promoters that can be used to promote mammalian expression of these enzymes include adenovirus late promoter, vaccinia virus 7.5K promoter, SV40 promoter, cytomegalovirus promoter, tk promoter of HSV, mouse mammary tumor virus (MMTV) promoter, LTR promoter of HIV, promoter of moloney virus, Epstein barr virus (EBV), Rous sarcoma virus (RSV), and the cytomegalovirus (CMV) promoter.

Once a polynucleotide encoding a water-forming NADH or NADPH oxidase has been incorporated into the nuclear DNA of a mammalian cell, the transcription of this polynucleotide can be induced by methods known in the art. For example expression can be induced by exposing the mammalian cell to an external chemical reagent, such as an agent that modulates the binding of a transcription factor and/or RNA polymerase to the mammalian promoter and thus regulate gene expression. The chemical reagent can serve to facilitate the binding of RNA polymerase and/or transcription factors to the mammalian promoter, e.g., by removing a repressor protein that has bound the promoter. Alternatively, the chemical reagent can serve to enhance the affinity of the mammalian promoter for RNA polymerase and/or transcription factors such that the rate of transcription of the gene located downstream of the promoter is increased in the presence of the chemical reagent. Examples of chemical reagents that potentiate polynucleotide transcription by the above mechanisms include tetracycline and doxycycline. These reagents are commercially available (Life Technologies, Carlsbad, CA) and can be administered to a mammalian cell in order to promote gene expression according to established protocols.

Other DNA sequence elements that may be included in polynucleotides for use in the compositions and methods of the invention include enhancer sequences. Enhancers represent another class of regulatory elements that induce a conformational change in the polynucleotide comprising the gene of interest such that the DNA adopts a three-dimensional orientation that is favorable for binding of transcription factors and RNA polymerase at the transcription initiation site. Thus, polynucleotides for use in the compositions and methods of the invention include those that encode a water-forming NADH or NADPH oxidase and additionally include a mammalian enhancer sequence. Many enhancer sequences are now known from mammalian genes, and examples include enhancers from the genes that encode mammalian globin, elastase, albumin, α-fetoprotein, and insulin. Enhancers for use in the compositions and methods of the invention also include those that are derived from the genetic material of a virus capable of infecting a eukaryotic cell. Examples include the SV40 enhancer on the late side of the replication origin (bp 100-270), the cytomegalovirus early promoter enhancer, the polyoma enhancer on the late side of the replication origin, and adenovirus enhancers. Additional enhancer sequences that induce activation of eukaryotic gene transcription are disclosed in Yaniv, et al. (Nature 297:17-18, 1982). An enhancer may be spliced into a vector containing a polynucleotide encoding a water-forming NADH oxidase, for example, at a position 5' or 3' to this gene. In a preferred orientation, the enhancer is positioned at the 5' side of the promoter, which in turn is located 5' relative to the polynucleotide encoding the water-forming NADH or NADPH oxidase.

In addition to providing the proper transcription activating elements, another technique that can be used to ensure stable expression of exogenous water-forming NADH or NADPH oxidases (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) in a mammalian cell is to optimize the polynucleotide comprising the gene for expression by the mammalian transcription and translation complexes. As a result of the multiplicity of codons that encode a single amino acid, it is frequently necessary to prepare polynucleotides that comprise codons that are preferentially recognized by the mammalian ribosome in order to ensure robust translation rates. For instance, the amino acid isoleucine is preferentially encoded by the codon ATT in certain bacterial cells, such as those of L. brevis. In human cells, however, isoleucine is preferentially encoded by the codon ATC. Cells of S. pneumoniae preferentially recognize the codon CAT to direct the incorporation of histidine into an elongating polypeptide chain, while human cells preferentially utilize the codon CAC to signal incorporation of the same amino acid. In view of the fact that water-forming NADH or NADPH oxidases are derived from lower-order organisms, such as L. brevis and S. pneumoniae, these enzymes may be inefficiently translated according to their native DNA sequence. The genes encoding these enzymes can be optimized for expression in human cells in order to ensure high rates of protein biosynthesis.

Vectors for the Expression of Water-Forming NADH or NADPH Oxidases

In addition to achieving high rates of transcription and translation, stable expression of an exogenous gene in a mammalian cell can be achieved by integration of the polynucleotide comprising the gene into the nuclear genome of the mammalian cell. A variety of vectors for the delivery and integration of polynucleotides encoding exogenous proteins into the nuclear DNA of a mammalian cell have been developed. Examples of expression vectors are disclosed in, e.g., WO 1994/11026 and are incorporated herein by reference. Expression vectors for use in the compositions and methods of the invention contain a polynucleotide sequence that encodes a water-forming NADH or NADPH oxidase (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof), as well as, e.g., additional sequence elements used for the expression of these enzymes and/or the integration of these polynucleotide sequences into the genome of a mammalian cell. Certain vectors that can be used for the expression of water-forming NADH or NADPH oxidases include plasmids that contain regulatory sequences, such as promoter and enhancer regions, which direct gene transcription. Other useful vectors for expression of water-forming NADH or NADPH oxidases contain polynucleotide sequences that enhance the rate of translation of these genes or improve the stability or nuclear export of the mRNA that results from gene transcription. These sequence elements include, e.g., 5' and 3' untranslated regions, an internal ribosomal entry site (IRES), and polyadenylation signal site in order to direct efficient transcription of the gene carried on the expression vector. The expression vectors of the invention may also contain a polynucleotide encoding a marker for selection of cells that contain such a vector. Examples of a suitable marker include genes that encode resistance to antibiotics, such as ampicillin, chloramphenicol, kanamycin, or nourseothricin.

Viral genomes provide a rich source of vectors that can be used for the efficient delivery of exogenous genes into a mammalian cell. Viral genomes are particularly useful vectors for gene delivery because the polynucleotides contained within such genomes are typically incorporated into the nuclear genome of a mammalian cell by generalized or specialized transduction. These processes occur as part of the natural viral replication cycle, and do not require added proteins or reagents in order to induce gene integration. Examples of viral vectors include a retrovirus, adenovirus (e.g., Ad5, Ad26, Ad34, Ad35, and Ad48), parvovirus (e.g., adeno-associated viruses), coronavirus, negative strand RNA viruses such as orthomyxovirus (e.g., influenza virus), rhabdovirus (e.g., rabies and vesicular stomatitis virus), paramyxovirus (e.g. measles and Sendai), positive strand RNA viruses, such as picornavirus and alphavirus, and double stranded DNA viruses including adenovirus, herpesvirus (e.g., Herpes Simplex virus types 1 and 2, Epstein-Barr virus, cytomegalovirus), and poxvirus (e.g., vaccinia, modified vaccinia Ankara (MVA), fowlpox and canarypox). Other viruses include Norwalk virus, togavirus, flavivirus, reoviruses, papovavirus, hepadnavirus, and hepatitis virus, for example. Examples of retroviruses include: avian leukosis-sarcoma, mammalian C-type, B-type viruses, D-type viruses, HTLV-BLV group, lentivirus, spumavirus (Coffin, J. M., Retroviridae: The viruses and their replication, In Fundamental Virology, Third Edition, B. N. Fields, et al., Eds., Lippincott-Raven Publishers, Philadelphia, 1996). Other examples include murine leukemia viruses, murine sarcoma viruses, mouse mammary tumor virus, bovine leukemia virus, feline leukemia virus, feline sarcoma virus, avian leukemia virus, human T-cell leukemia virus, baboon endogenous virus, Gibbon ape leukemia virus, Mason Pfizer monkey virus, simian immunodeficiency virus, simian sarcoma virus, Rous sarcoma virus and lentiviruses. Other examples of vectors are described, for example, in McVey et al. (U.S. Pat. No. 5,801,030), the teachings of which are incorporated herein by reference.

Incorporation of Polynucleotides by Gene Editing Techniques

In addition to viral vectors, a variety of additional tools have been developed for the incorporation of exogenous genes into mammalian cells. One such method that can be used for incorporating polynucleotides encoding water-forming NADH or NADPH oxidases (for instance, a water-forming NADH oxidase having the amino acid sequence of any one of SEQ ID NOs: 1-273, such as a water-forming NADH oxidase having the amino acid sequence of any one of SEQ ID NOs: 1-5, or a water-forming NADPH oxidase having the amino acid sequence of SEQ ID NO: 329 or 330) into mammalian cells includes transposons. Transposons are polynucleotides that encode transposase enzymes and contain a polynucleotide sequence or gene of interest flanked by excision sites at the 5' and 3' positions. Once a transposon has been delivered into a cell, expression of the transposase gene commences and results in active enzymes that cleave the gene of interest from the transposon. This activity is mediated by the site-specific recognition of transposon excision sites by the transposase. In certain cases, these excision sites may be terminal repeats or inverted terminal repeats. Once excised from the transposon, the gene of interest can be integrated into the genome of a mammalian cell by transposase-catalyzed cleavage of similar excision sites that exist within nuclear genome of the cell. This allows the gene of interest to be inserted into the cleaved nuclear DNA at the excision sites, and subsequent ligation of the phosphodiester bonds that join the gene of interest to the DNA of the mammalian cell genome completes the incorporation process. In certain cases, the transposon may be a retrotransposon, such that the gene encoding the water-forming NADH or NADPH oxidase is first transcribed to an RNA product and then reverse-transcribed to DNA before incorporation in the mammalian cell genome. Exemplary transposon systems include the piggybac transposon (described in detail in WO 2010/085699) and the sleeping beauty transposon (described in detail in US20050112764), the teachings of both of which are incorporated herein by reference.

Another useful tool for the integration of water-forming NADH or NADPH oxidases (for instance, a water-forming NADH oxidase having the amino acid sequence of any one of SEQ ID NOs: 1-273, such as a water-forming NADH oxidase having the amino acid sequence of any one of SEQ ID NOs: 1-5, or a water-forming NADPH oxidase having the amino acid sequence of SEQ ID NO: 329 or 330) into the genome of a mammalian cell is the clustered regularly interspaced short palindromic repeats (CRISPR)/Cas system, which is a system that originally evolved as an adaptive defense mechanism in bacteria and archaea against infection by viruses. The CRISPR/Cas system consists of palindromic repeat sequences within plasmid DNA and an associated Cas9 nuclease. This ensemble of DNA and protein directs site specific DNA cleavage of a target sequence by first incorporating foreign DNA into CRISPR loci. Polynucleotides containing these foreign sequences and the repeat-spacer elements of the CRISPR locus are in turn transcribed in a host cell to create a guide RNA, which can subsequently anneal to a target sequence and localize the Cas9 nuclease to this site. In this manner, highly site-specific cas9-mediated DNA cleavage can be engendered in a foreign polynucleotide because the interaction that brings cas9 within close proximity of the target DNA molecule is governed by RNA:DNA hybridization. As a result, one can theoretically design a CRISPR/Cas system to cleave any target DNA molecule of interest. This technique has been exploited in order to edit eukaryotic genomes (Hwang, et al., Nat. Biotech., 31:227-229, 2013) and can be used as an efficient means of site-specifically editing mammalian genomes in order to cleave DNA prior to the incorporation of a gene encoding a water-forming NADH oxidase. The use of CRISPR/Cas to modulate gene expression has been described in U.S. Pat. No. 8,697,359, which is incorporated herein by reference. Alternative methods for site-specifically cleaving genomic DNA prior to the incorporation of a gene of interest include the use of zinc finger nucleases and transcription activator-like effector nucleases (TALENs). Unlike the CRISPR/Cas system, these enzymes do not contain a guiding polynucleotide to localize to a specific target sequence. Target specificity is instead controlled by DNA binding domains within these enzymes. Zinc finger nucleases and TALENs for use in genome editing applications are described in Urnov, et al., Nat. Rev. Genet., 11:636-646, 2010; and in Joung, et al., Nat. Rev. Mol. Cell. Bio., 14:49-55, 2013, the teachings of both of which are incorporated herein by reference. Additional genome editing techniques that can be used to incorporate polynucleotides encoding water-forming NADH or NADPH oxidases into the genome of a mammalian cell include the use of ARCUS™ meganucleases that can be rationally designed so as to site-specifically cleave genomic DNA. The use of these enzymes for the incorporation of genes encoding water-forming NADH or NADPH oxidases into the genome of a mammalian cell is particularly advantageous in view of the structure-activity relationships that have been established for such enzymes. Single chain meganucleases can be modified at certain amino acid positions in order to create nucleases that selectively cleave DNA at desired locations. These single-chain nucleases have been described extensively, e.g., in U.S. Pat. Nos. 8,021,867 and 8,445,251, the teachings of which are incorporated herein by reference.

Protein Prosthesis Therapy

Water-forming NADH or NADPH oxidases (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) can also be administered directly to a patient in order to treat a disease associated with mitochondrial defect. Delivering whole proteins across the mammalian cell membrane has posed a challenge to the medicinal chemistry community, since the large size and hydrophilic exterior of many proteins renders these molecules difficult and often intractable substrates for traversing the lipophilic environment of the plasma membrane (Benson, et al., J. Pharm. Sci., 97:3591-3610, 2008). However, the need to deliver whole proteins into the cytosol of a mammalian cell has inspired the development of a variety of strategies that can be used for translocating water-forming NADH oxidases across the cell membrane (Pisal, et al., J. Pharm. Sci., 99:2557-2575, 2010). A common method for protein delivery into a mammalian cell has been to deliver the protein in combination with a liposome. Liposomes are synthetic vesicles that contain a lipid bilayer separated exterior that surrounds an aqueous interior. Liposomes offer the ability to bind to and fuse with the mammalian cell membrane, releasing proteins that stored in the aqueous interior of the liposome into the cytosol of the target cell. Moreover, liposomes comprised of phospholipids are well-suited for the delivery of water-forming NADH or NADPH oxidases into a mammalian cell. Due to the amphipathic nature of phospholipids, these molecules are compatible with oxidases that are derived from a diversity of sources and that may present different physicochemical properties.

Supramolecular complexes, such as liposomes, nanoparticles, and nanospheres, capable of encapsulating water-forming NADH or NADPH oxidases (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) can be used in order to efficiently deliver these enzymes to the mammalian cell interior with minimal degradation of the protein before it reaches the cellular target. For instance, nanoparticles and liposomes can be conjugated to extended hydrophilic polymers, such as polyethylene glycol (PEG), or hyperglycosylated by conjugation with carbohydrates, such as polysialic acid (PSA), in order to improve the solubility of these complexes in aqueous solution and to mask these complexes from recognition by the immune system. The mounting of an adaptive immune response by a patient in the form of antibodies raised against liposomes represents one means by which the water-forming NADH or NADPH oxidase can be degraded in serum of a patient before reaching a cellular target. This can result in early clearance of these enzymes from serum and a poor pharmacokinetic profile. Premature degradation can be prevented by conjugation of liposomes to PEG or PSA, which sterically preclude the binding of surface antigens to B-cell receptors and thus attenuate immunogenicity of the complex (Gregoriadis, Int. J. Pharm., 300:125-130, 2005). Methods for the use of liposomes to enable protein delivery have been described in detail in WO 2013/140643, WO 2005/051351, and WO 2001/043778, each of which is incorporated herein by reference.

Microspheres represent an additional tool for the delivery of protein therapeutics across the mammalian cell membrane. Encapsulation of a water-forming NADH or NADPH oxidase (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) within a microsphere offers beneficial features similar to nanoparticles and liposomes, as these vesicle-like structures protect protein cargo buried in the microsphere interior from degradation. Microspheres, particularly those comprised of hydrophilic polymers such as poly(D,L-lactic-coglycolic-acid) (PLGA), are water-soluble, biodegradable, and can facilitate the extended release of a water-forming NADH or NADPH oxidase over the course of days, weeks, or even months. Microspheres feature a high degree of tensile strength and can be tuned so as to achieve an ideal rate of release of proteins encapsulated in the interior. These complexes have been used for the delivery of a variety of therapeutic proteins, and are discussed in further detail in Cai, et al., Biomaterials, 24:629-638, 2003; Sing, Int. J. Pharm., 341:68-77, 2007; and Mundargi, J. Control. Release., 125:193-209, 2008, the teachings of each of which is incorporated herein by reference.

Therapeutic Conjugates and Fusion Proteins Containing Water-Forming NADH or NADPH Oxidases Prior to administration of a water-forming NADH or NADPH oxidase (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) for use in the compositions and methods of the invention to a patient (e.g., a human patient), it may be desirable to conjugate the enzyme to a second molecule in order to modulate the activity of the enzyme for in vivo applications. Water-forming NADH or NADPH oxidases can be conjugated to other molecules at either the N-terminus or C-terminus of the enzyme using any one of a variety of established conjugation strategies that are well-known in the art. Examples of pairs of reactive functional groups that can be used to covalently tether a water-forming NADH or NADPH oxidase to another molecule include, without limitation, thiol pairs, carboxylic acids and amino groups, ketones and amino groups, aldehydes and amino groups, thiols and alpha, beta-unsaturated moieties (such as maleimides or dehydroalanine), thiols and alpha-halo amides, carboxylic acids and hydrazides, aldehydes and hydrazides, and ketones and hydrazides.

Water-forming NADH or NADPH oxidases (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) can be covalently appended directly to another molecule by chemical conjugation as described. Alternatively, fusion proteins containing water-forming NADH or NADPH oxidases can be expressed recombinantly from a cell (e.g., a mammalian cell). This can be accomplished, for example, by incorporating a polynucleotide encoding the fusion protein into the nuclear genome of a cell using genome editing techniques, such as those described herein or known in the art. Optionally, these enzymes can be joined to a second molecule by forming a covalent bond between the oxidase and a linker. This linker can then be subsequently conjugated to another molecule, or the linker can be conjugated to another molecule prior to ligation to the water-forming NADH or NADPH oxidase. Examples of linkers that can be used for the formation of a conjugate include polypeptide linkers, such as those that contain naturally occurring or non-naturally occurring amino acids. In certain cases, it may be desirable to include D-amino acids in the linker, as these residues are not present in naturally-occurring proteins and are thus more resistant to degradation by endogenous proteases. Fusion proteins containing polypeptide linkers can be made using chemical synthesis techniques, such as those described herein, or through recombinant expression of a polynucleotide encoding the fusion protein in a cell (e.g., a mammalian cell). Linkers can be prepared using a variety of strategies that are well known in the art, and depending on the reactive components of the linker, can be cleaved by enzymatic hydrolysis, photolysis, hydrolysis under acidic conditions, hydrolysis under basic conditions, oxidation, disulfide reduction, nucleophilic cleavage, or organometallic cleavage (Leriche, et al., Bioorg. Med. Chem., 20:571-582, 2012).

Water-forming NADH or NADPH oxidase conjugates may also be produced using, e.g., a linker that joins the NADH or NADPH oxidase to its fusion partner and that is cleavable by intracellular enzymes. The linker can be designed so that it can be cleaved in order to separate the two agents at a particular time or cellular location. Examples of such linkers include polypeptides that include an amino acid sequence that is selectively recognized and cleaved by proteases, such as, e.g., trypsin, chymotrypsin, thrombin, and pepsin, among others.

Water-forming NADH or NADPH oxidases (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) can be conjugated to other molecules for the purpose of improving the solubility and stability of the protein in aqueous solution. Examples of such molecules include PEG, PSA, bovine serum albumin (BSA), and human serum albumin (HSA), among others. For instance, one can conjugate a water-forming NADH or NADPH oxidase to carbohydrate moieties in order to evade detection of the enzyme by the immune system of the patient receiving treatment. This process of hyperglycosylation reduces the immunogenicity of therapeutic proteins by sterically inhibiting the interaction of the protein with B-cell receptors in circulation. Alternatively, water-forming NADH or NADPH oxidases can be conjugated to molecules that prevent clearance from human serum and improve the pharmacokinetic profile of these oxidases. For instance, one may conjugate a water-forming NADH or NADPH oxidase to an antibody Fc region. These antibody domains impart protein therapeutics with an enhanced serum half-life by interacting with specific serum proteins. In this way, water-forming NADH OR NADPH oxidases can evade premature clearance from circulation and exhibit an improved pharmacokinetic profile.

Additional conjugates of water-forming NADH or NADPH oxidases that can be formed for therapeutic applications include those that contain cell-penetrating peptides (CPPs). CPPs are polypeptides that contain an abundance of cationic amino acids and, as such, engage in strong ionic contacts with the negatively charged exterior of the mammalian cell membrane. These compounds are capable of penetrating the cell membrane by one of a variety of mechanisms, including destabilization of the membrane structure, pore formation, endocytosis, and macropinocytosis, among others. CPPs have been shown not only to translocate across the mammalian cell membrane, but are also capable of delivering other molecules to which these compounds are covalently bound into the mammalian cell interior. The use of CPPs is described in Snyder, et al., (Pharm. Res., 21:389-393, 2004), the teachings of which are incorporated by reference. Examples of cell penetrating peptides that can be conjugated to water-forming NADH or NADPH oxidases are provided in SEQ ID NOs: 279-297. For instance, one can conjugate the N-terminal amine of a water-forming NADH or NADPH oxidase to the C-terminal carboxylate of a cell penetrating peptide by formation of an amide bond using amide-bond forming reagents and processes known in the art.

Water-forming NADH or NADPH oxidases (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) can also be conjugated to molecules that direct these enzymes to particular sub-cellular locations, including specific organelles. Examples of organelles to which a water-forming NADH or NADPH oxidase for use in the compositions and methods of the invention can be localized in this manner include the mitochondria, peroxisome, and golgi complexes, among others. For example, it may be desirable to target a therapeutic water-forming NADH or NADPH oxidase to the mitochondria of a patient (e.g., a human patient) in order to provide an enzyme capable of bypassing a deficient or inactive respiratory chain. One can conjugate a water-forming NADH or NADPH oxidase for use in the compositions and methods of the invention to a mitochondrial targeting sequence (MTS) derived from any mitochondrial protein that is produced outside of the mitochondria. Prediction of the MTS from a given protein is routine in the art, and methods describing the prediction of such sequences are described in Claros, et al., Eur. J. Biochem., 241:779-786, 1996, the teachings of which are incorporated herein by reference. The water-forming NADH oxidase can be conjugated to a MTS through recombinant techniques or chemical synthesis (e.g., covalently joining a reactive functional group of the enzyme, such as the N-terminal amine or C-terminal carboxylate, with a reactive functional group of the MTS peptide using conventional covalent bond-forming methodologies that are known in the art). Examples of mitochondrial targeting sequences include the MTS of sub-unit IV of human cytochrome c oxidase (SEQ ID NO: 298), a MTS derived from a mitochondrial enzyme, such as fumarase (MLRFTNCSCKTFVKSSYKLNIRRMNSSFRT, SEQ ID NO: 299) or aconitase (MLSARSAIKRPIVRGLATV, SEQ ID NO: 300), as well as chimeric sequences that include residues from the MTS motifs of two different mitochondrial proteins (e.g., MLSARSAIKRPIVRGLATVSSFRT, SEQ ID NO: 301; MLRSSVVRSRATLRPLLRRAYSSSFRT, SEQ ID NO: 302; MLRFTNCSCKTFVKSSYKLNIRRMNTV, SEQ ID NO: 303; MLSARSAIKRPIVRGLATV, SEQ ID NO: 304; MLSRRSAIKRPIVRGLATV, SEQ ID NO: 305; MLSASSAIKRPIVRGLATV, SEQ ID NO: 306; MLSARSARKRPIVRGLATV, SEQ ID NO: 307; MLSARSAICRPIVRGLATV, SEQ ID NO: 308; MLSTAYAIKRPIVRGLATV, SEQ ID NO: 309; MLSARSAIPIPIVRGLATV, SEQ ID NO: 310; MLSARSAIKRPIVRGYKLNIRRMNTV, SEQ ID NO: 311; MLSARSAIKRPIVRGKRPIVRGLATV, SEQ ID NO: 312; MLSFTNCSCKTFVKSSYKLNIRRMN, SEQ ID NO: 313; MLRFRNCSCKTFVKSSYKLNIRRMN, SEQ ID NO: 314; MLRFTNCSKKTFVKSSYKLNIRRMN, SEQ ID NO: 315; described in detail by Regev-Rudzki, et al., J. Cell. Sci., 121:2423-2431, 2008, the teachings of which are incorporated herein by reference).

In certain cases, it may be desirable to covalently conjugate the enzymes for use in the compositions and methods of the invention with a chelating group capable of binding a metal ion from heavy elements or rare earth ions, such as $Gd^{3+}$, $Fe^{3+}$, $Mn^{3+}$, or $Cr^{2+}$. Conjugates containing chelating groups that are coordinated to such paramagnetic metals are useful as in MRI imaging applications. Paramagnetic metals include, but are not limited to, chromium (III), manganese (II), iron (II), iron (III), cobalt (II), nickel (II), copper (II), praseodymium (III), neodymium (III), samarium (III), gadolinium (III), terbium (III), dysprosium (III), holmium (III), erbium (III), and ytterbium (III). In this way, water-forming NADH or NADPH oxidases can be detected by MRI spectroscopy. For instance, one can administer water-forming NADH or NADPH oxidases conjugated to chelating groups bound to paramagnetic ions to a patient (e.g., a human patient) in order to monitor the distribution of the enzyme following administration. This can be achieved by administration of the enzyme to a patient by any of the administration routes described herein, such as intravenously, and subsequently analyzing the location of the administered enzymes by recording an MRI of the patient according to established protocols.

Water-forming NADH or NADPH oxidases (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) can additionally be conjugated to a cytotoxic molecule. Such conjugates may be applicable to the treatment, prevention, or analysis of a disease associated with aberrant cell proliferation. Examples of such diseases that may be amenable to treatment with conjugates comprising a water-forming NADH or NADPH oxidase and a cytotoxic agent include, without limitation, breast cancer, paraganglioma, phaeochromocytoma, leiomyoma, leiomyosarcoma, and renal cell carcinoma. Exemplary cytotoxic molecules that can be conjugated to, admixed with, or administered separately from a water-forming NADH or NADPH oxidase include, without limitation, antineoplastic agents such as: acivicin; aclarubicin; acodazole hydrochloride; acronine; adozelesin; adriamycin; aldesleukin; altretamine; ambomycin; a. metantrone acetate; aminoglutethimide; amsacrine; anastrozole; anthramycin; asparaginase; asperlin; azacitidine; azetepa; azotomycin; batimastat; benzodepa; bicalutamide; bisantrene hydrochloride; bisnafide dimesylate; bizelesin; bleomycin sulfate; brequinar sodium; bropirimine; busulfan; cactinomycin; calusterone; camptothecin; caracemide; carbetimer; carboplatin; carmustine; carubicin hydrochloride; carzelesin; cedefingol; chlorambucil; cirolemycin; cisplatin; cladribine; combretestatin a-4; crisnatol mesylate; cyclophosphamide; cytarabine; dacarbazine; daca (n-[2-(dimethyl-amino) ethyl] acridine-4-carboxamide); dactinomycin; daunorubicin hydrochloride; daunomycin; decitabine; dexormaplatin; dezaguanine; dezaguanine mesylate; diaziquone; docetaxel; dolasatins; doxorubicin; doxorubicin hydrochloride; droloxifene; droloxifene citrate; dromostanolone propionate; duazomycin; edatrexate; eflornithine hydrochloride; ellipticine; elsamitrucin; enloplatin; enpromate; epipropidine; epirubicin hydrochloride; erbulozole; esorubicin hydrochloride; estramustine; estramustine phosphate sodium; etanidazole; ethiodized oil i 131; etoposide; etoposide phosphate; etoprine; fadrozole hydrochloride; fazarabine; fenretinide; floxuridine; fludarabine phosphate; fluorouracil; 5-fdump; flurocitabine; fosquidone; fostriecin sodium; gemcitabine; gemcitabine hydrochloride; gold au 198; homocamptothecin; hydroxyurea; idarubicin hydrochloride; ifosfamide; ilmofosine; interferon alfa-2a; interferon alfa-2b; interferon alfa-nl; interferon alfa-n3; interferon beta-i a; interferon gamma-i b; iproplatin; irinotecan hydrochloride; lanreotide acetate; letrozole; leuprolide acetate; liarozole hydrochloride; lometrexol sodium; lomustine; losoxantrone hydrochloride; masoprocol; maytansine; mechlorethamine hydrochloride; megestrol acetate; melengestrol acetate; melphalan; menogaril; mercaptopurine; methotrexate; methotrexate sodium; metoprine; meturedepa; mitindomide; mitocarcin; mitocromin; mitogillin; mitomalcin; mitomycin; mitosper; mitotane; mitoxantrone hydrochloride; mycophenolic acid; nocodazole; nogalamycin; ormaplatin; oxisuran; paclitaxel; pegaspargase; peliomycin; pentamustine; peploycinsulfate; perfosfamide; pipobroman; piposulfan; piroxantrone hydrochloride; plicamycin; plomestane; porfimer sodium; porfiromycin; prednimustine; procarbazine hydrochloride; puromycin; puromycin hydrochloride; pyrazofurin; rhizoxin; rhizoxin d; riboprine; rogletimide; safingol; safingol hydrochloride; semustine; simtrazene; sparfosate sodium; sparsomycin; spirogermanium hydrochloride; spiromustine; spiroplatin; streptonigrin; streptozocin; strontium chloride sr 89; sulofenur; talisomycin; taxane; taxoid; tecogalan sodium; tegafur; teloxantrone hydrochloride; temoporfin; teniposide; teroxirone; testolactone; thiamiprine; thioguanine; thiotepa; thymitaq; tiazofurin; tirapazamine; tomudex; top53; topotecan hydrochloride; toremifene citrate; trestolone acetate; triciribine phosphate; trimetrexate; trimetrexate glucuronate; triptorelin; tubulozole hydrochloride; uracil mustard; uredepa; vapreotide; verteporfin; vinblastine; vinblastine sulfate; vincristine; vincristine sulfate; vindesine; vindesine sulfate; vinepidine sulfate; vinglycinate sulfate; vinleurosine sulfate; vinorelbine tartrate; vinrosidine sulfate; vinzolidine sulfate; vorozole; zeniplatin; zinostatin; zorubicin hydrochloride; 2-chlorodeoxyadenosine; 2' deoxyformycin; 9-aminocamptothecin; raltitrexed; N-propargyl-5,8-dideazafolic acid; 2chloro-2'-arabino-fluoro-2'-deoxyadenosine; 2-chloro-2'-deoxyadenosine; anisomycin; trichostatin A; hPRL-G129R; CEP-751; linomide; sulfur mustard; nitrogen mustard (mechlor ethamine); cyclophosphamide; melphalan; chlorambucil; ifosfamide; busulfan; N-methyl-Nnitrosourea (MNU); N, N'-Bis (2-chloroethyl)-N-nitrosourea (BCNU); N-(2-chloroethyl)-N' cyclohexyl-N-nitrosourea (CCNU); N-(2-chloroethyl)-N'-(trans-4-methylcyclohexyl-N-nitrosourea (MeCCNU); N-(2-chloroethyl)-N'-(diethyl) ethylphosphonate-N-nitrosourea (fotemustine); streptozotocin; diacarbazine (DTIC); mitozolomide; temozolomide; thiotepa; mitomycin C; AZQ; adozelesin; cisplatin; carboplatin; ormaplatin; oxaliplatin; C1-973; DWA 2114R; JM216; JM335; Bis (platinum); tomudex; azacitidine; cytarabine; gemcitabine; 6-mercaptopurine; 6-thioguanine; hypoxanthine; teniposide 9-amino camptothecin; topotecan; CPT-11; Doxorubicin; Daunomycin; Epirubicin; darubicin; mitoxantrone; losoxantrone; Dactinomycin (Actinomycin D); amsacrine; pyrazoloacridine; all-trans retinol; 14-hydroxy-retro-retinol; all-trans retinoic acid; N-(4-hydroxyphenyl) retinamide; 13-cis retinoic acid; 3-methyl TTNEB; 9-cis retinoic acid; fludarabine (2-F-ara-AMP); or 2-chlorodeoxyadenosine (2-Cda).

Other therapeutic compounds that can be conjugated to, admixed with, or administered separately from a water-forming NADH or NADPH oxidase in order to treat, prevent, or study the progression of a disease associated with aberrant cell proliferation include, but are not limited to, 20-pi-1,25 dihydroxyvitamin D3; 5-ethynyluracil; abiraterone; acylfulvene; adecypenol; adozelesin; aldesleukin; ALL-TK antagonists; altretamine; ambamustine; amidox; amifostine; aminolevulinic acid; amrubicin; amsacrine; anagrelide; anastrozole; andrographolide; angiogenesis inhibitors; antagonist D; antagonist G; antarelix; anti-dorsalizing morphogenetic protein-1; antiandrogen, prostatic carcinoma; antiestrogen; antineoplaston; antisense oligonucleotides; aphidicolin glycinate; apoptosis gene modulators; apoptosis regulators; apurinic acid; ara-CDP-DL-PTBA; argininedeaminase; asulacrine; atamestane; atrimustine; axinastatin 1; axinastatin 2; axinastatin 3; azasetron; azatoxin; azatyrosine; baccatin III derivatives; balanol; batimastat; BCR/ABL antagonists; benzochlorins; benzoylstaurosporine; beta lactam derivatives; beta-alethine; betaclamycin B; betulinic acid; bFGF inhibitor; bicalutamide; bisantrene; bisaziridinylspermine; bisnafide; bistratene A; bizelesin; breflate; bleomycin A2; bleomycin B2; bropirimine; budotitane; buthionine sulfoximine; calcipotriol; calphostin C; camptothecin derivatives (e.g., 10-hydroxy-camptothecin); canarypox IL-2; capecitabine; carboxamide-amino-triazole; carboxyamidotriazole; CaRest M3; CARN 700; cartilage derived inhibitor; carzelesin; casein kinase inhibitors (ICOS); castanospermine; cecropin B; cetrorelix; chlorins; chloroquinoxaline sulfonamide; cicaprost; cis-porphyrin; cladribine; clomifene analogues; clotrimazole; collismycin A; collismycin B; combretastatin A4; combretastatin analogue; conagenin; crambescidin 816; crisnatol; cryptophycin 8; cryptophycin A derivatives; curacin A; cyclopentanthraquinones; cycloplatam; cypemycin; cytarabine ocfosfate; cytolytic factor; cytostatin; dacliximab; decitabine; dehydrodidemnin B; 2'deoxycoformycin (DCF); deslorelin; dexifosfamide; dexrazoxane; dexverapamil; diaziquone; didemnin B; didox; diethylnorspermine; dihydro-5-azacytidine; dihydrotaxol, 9-; dioxamycin; diphenyl spiromustine; discodermolide; docosanol; dolasetron; doxifluridine; droloxifene; dronabinol; duocarmycin SA; ebselen; ecomustine; edelfosine; edrecolomab; eflornithine; elemene; emitefur; epirubicin; epothilones (A, R=H; B, R=Me); epithilones; episteride; estramustine analogue; estrogen agonists; estrogen antagonists; etanidazole; etoposide; etoposide 4'-phosphate (etopofos); exemestane; fadrozole; fazarabine; fenretinide; filgrastim; finasteride; flavopiridol; flezelastine; fluasterone; fludarabine; fluorodaunorunicin hydrochloride; forfenimex; formestane; fostriecin; fotemustine; gadolinium texaphyrin; gallium nitrate; galocitabine; ganirelix; gelatinase inhibitors; gemcitabine; glutathione inhibitors; hepsulfam; heregulin; hexamethylene bisacetamide; homoharringtonine (HHT); hypericin; ibandronic acid; idarubicin; idoxifene; idramantone; ilmofosine; ilomastat; imidazoacridones; imiquimod; immunostimulant peptides; insulin-like growth factor-1 receptor inhibitor; interferon agonists; interferons; interleukins; iobenguane; iododoxorubicin; ipomeanol, 4-; irinotecan; iroplact; irsogladine; isobengazole; isohomohalicondrin B; itasetron; jasplakinolide; kahalalide F; lamellarin-N triacetate; lanreotide; leinamycin; lenograstim; lentinan sulfate; leptolstatin; letrozole; leukemia inhibiting factor; leukocyte alpha interferon; leuprolide+estrogen+progesterone; leuprorelin; levamisole; liarozole; linear polyamine analogue; lipophilic disaccharide peptide; lipophilic platinum compounds; lissoclinamide 7; lobaplatin; lombricine; lometrexol; lonidamine; losoxantrone; lovastatin; loxoribine; lurtotecan; lutetium texaphyrin; lysofylline; lytic peptides; maytansine; mannostatin A; marimastat; masoprocol; maspin; matrilysin inhibitors; matrix metalloproteinase inhibitors; menogaril; rnerbarone; meterelin; methioninase; metoclopramide; MIF inhibitor; ifepristone; miltefosine; mirimostim; mismatched double stranded RNA; mithracin; mitoguazone; mitolactol; mitomycin analogues; mitonafide; mitotoxin fibroblast growth factor-saporin; mitoxantrone; mofarotene; molgramostim; monoclonal antibody, human chorionic gonadotrophin; monophosphoryl lipid A+myobacterium cell wall sk; mopidamol; multiple drug resistance gene inhibitor; multiple tumor suppressor 1-based therapy; mustard anticancer agent; mycaperoxide B; mycobacterial cell wall extract; myriaporone; N-acetyldinaline; N-substituted benzamides; nafarelin; nagrestip; naloxone+pentazocine; napavin; naphterpin; nartograstim; nedaplatin; nemorubicin; neridronic acid; neutral endopeptidase; nilutamide; nisamycin; nitric oxide modulators; nitroxide antioxidant; nitrullyn; 06-benzylguanine; octreotide; okicenone; oligonucleotides; onapristone; ondansetron; ondansetron; oracin; oral cytokine inducer; ormaplatin; osaterone; oxaliplatin; oxaunomycin; paclitaxel analogues; paclitaxel derivatives; palauamine; palmitoylrhizoxin; pamidronic acid; panaxytriol; panomifene; parabactin; pazelliptine; pegaspargase; peldesine; pentosan polysulfate sodium; pentostatin; pentrozole; perflubron; perfosfamide; perillyl alcohol; phenazinomycin; phenylacetate; phosphatase inhibitors; picibanil; pilocarpine hydrochloride; pirarubicin; piritrexim; placetin A; placetin B; plasminogen activator inhibitor; platinum complex; platinum compounds; platinum-triamine complex; podophyllotoxin; porfimer sodium; porfiromycin; propyl bis-acridone; prostaglandin J2; proteasome inhibitors; protein A-based immune modulator; protein kinase C inhibitor; protein kinase C inhibitors, microalgal; protein tyrosine phosphatase inhibitors; purine nucleoside phosphorylase inhibitors; purpurins; pyrazoloacridine; pyridoxylated hemoglobin polyoxyethylene conjugate; raf antagonists; raltitrexed; ramosetron; ras farnesyl protein transferase inhibitors; ras inhibitors; ras-GAP inhibitor; retelliptine demethylated; rhenium Re 186 etidronate; rhizoxin; ribozymes; RII retinamide; rogletimide; rohitukine; romurtide; roquinimex; rubiginone B 1; ruboxyl; safingol; saintopin; SarCNU; sarcophytol A; sargramostim; Sdi 1 mimetics; semustine; senescence derived inhibitor 1; sense oligonucleotides; signal transduction inhibitors; signal transduction modulators; single chain antigen binding protein; sizofiran; sobuzoxane; sodium borocaptate; sodium phenylacetate; solverol; somatomedin binding protein; sonermin; sparfosic acid; spicamycin D; spiromustine; splenopentin; spongistatin 1; squalamine; stem cell inhibitor; stem-cell division inhibitors; stipiamide; stromelysin inhibitors; sulfinosine; superactive vasoactive intestinal peptide antagonist; suradista; suramin; swainsonine; synthetic glycosaminoglycans; tallimustine; tamoxifen methiodide; tauromustine; tazarotene; tecogalan sodium; tegafur; tellurapyrylium; telomerase inhibitors; temoporfin; temozolomide; teniposide; tetrachlorodecaoxide; tetrazomine; thaliblastine; thalidomide; thiocoraline; thrombopoietin; thrombopoietin mimetic; thymalfasin; thymopoietin receptor agonist; thymotrinan; thyroid stimulating hormone; tin ethyl etiopurpurin; tirapazamine; titanocene dichloride; topotecan; topsentin; toremifene; totipotent stem cell factor; translation inhibitors; tretinoin; triacetyluridine; triciribine; trimetrexate; triptorelin; tropisetron; turosteride; tyrosine kinase inhibitors; tyrphostins; UBC inhibitors; ubenimex; urogenital sinus-derived growth inhibitory factor; urokinase receptor antagonists; vapreotide; variolin B; vector system, erythrocyte gene therapy; velaresol; veramine; verdins; verteporfin; vinorelbine; vinxaltine; vitaxin; vorozole; zanoterone; zeniplatin; zilascorb; and zinostatin stimalamer.

In addition to the conjugates described above, it may optionally be desirable to conjugate a water-forming NADH or NADPH oxidase to an antibody that selectively recognizes a particular antigen. Antibody conjugation represents a useful strategy for directing a water-forming NADH or NADPH oxidase to a particular target cell, e.g., a cancerous human cell. Alternatively, water-forming NADH or NADPH oxidases may be admixed with a therapeutic antibody in a single pharmaceutical composition. In certain cases, it may be desirable to administer a water-forming NADH or NADPH oxidase and a therapeutic antibody to a patient in separate pharmaceutical compositions. For instance, a patient receiving treatment for a cell proliferation disease, such as cancer, by administration of water-forming NADH or NADPH oxidases may optionally be treated with water-forming NADH or NADPH oxidases that are conjugated to, admixed with, or administered separately from a monoclonal antibody that selectively recognizes and binds an antigen that is expressed by a cancer cell. Examples of FDA-approved monoclonal antibodies that can be conjugated to, admixed with, or administered separately from a water-forming NADH or NADPH oxidase for the purposes of treating a patient suffering from a cell proliferation disorder (e.g., cancer) include Trastuzamb (HERCEPTIN®), Bevacizumab (AVASTIN®), Cetuximab (ERBITUX®), Panitumumab (VECTIBIX®), Ipilimumab (YERVOY®), Rituximab (RITUXAN® and MABTHERA®), Alemtuzumab (CAMPATH®), Ofatumumab (ARZERRA®), Gemtuzumab ozogamicin (MYLOTARG®), Brentuximab vedotin (ADCETRIS®), $^{90}$Y-Ibritumomab Tiuxetan (ZEVALIN®), and $^{131}$I-Tositumomab (BEXXAR®), which are described in detail in Scott, et al., Cancer Immun., 12:14-21, 2012, the teachings of which are incorporated herein by reference.

Pharmaceutical Formulations

Therapeutic formulations of a composition comprising a water-forming NADH or NADPH oxidase (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof), a conjugate comprising the water-forming NADH or NADPH oxidase, a polynucleotide encoding the water-forming NADH or NADPH oxidase or a conjugate thereof, or a vector comprising such a polynucleotide can be prepared using methods known in the art. For example, such compositions can be prepared using, e.g., physiologically acceptable carriers, excipients or stabilizers (*Remington's Pharmaceutical Sciences* 16th edition, Osol, A. Ed. (1980), incorporated herein by reference), and in a desired form, e.g., in the form of lyophilized formulations or aqueous solutions. The compositions can also be prepared so as to contain the active agent (e.g., water-forming NADH or NADPH oxidase, polynucleotide encoding a water-forming NADH or NADPH oxidase, a vector containing such a polynucleotide, a mammalian cell that expresses a water-forming NADH oxidase) at a desired level of purity. For example, a pharmaceutical formulation for use with the methods of the invention may contain at least 10% (e.g., 10%, 20%, 30%, 40%, 50%, 60%, 70%, 80%, 90%, 95%, 97%, 98%, 99%, 99.5%, 99.9%, or 100%) active agent by weight (w/w). Additionally, an active agent, e.g., a water-forming NADH or NADPH oxidase, that can be incorporated into a pharmaceutical formulation can itself have a desired level of purity relative to the mixture from which the enzyme is isolated or produced. For instance, a water-forming NADH or NADPH oxidase for use with the methods and compositions of the invention may be at least 10% pure (e.g., 10%, 20%, 30%, 40%, 50%, 60%, 70%, 80%, 90%, 95%, 97%, 98%, 99%, 99.5%, 99.9%, or 100% pure). Acceptable carriers, excipients, or stabilizers are nontoxic to patients at the dosages and concentrations employed, and include buffers, such as phosphate, citrate, and other organic acids; antioxidants, including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens, such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids, such as glycine, glutamine, asparagine, histidine, arginine, or lysine; monosaccharides, disaccharides, and other carbohydrates including glucose, mannose, or dextrins; chelating agents, such as EDTA; sugars such as sucrose, mannitol, trehalose or sorbitol; salt-forming counter-ions, such as sodium; metal complexes (e.g., Zn-protein complexes); and/or non-ionic surfactants such as TWEEN™, PLURONICS™, or polyethylene glycol (PEG).

The pharmaceutically acceptable carrier may alternatively comprise dextrose, sucrose, sorbitol, mannitol, starch, rubber arable, potassium phosphate, arginate, gelatin, potassium silicate, microcrystalline cellulose, polyvinylpyrrolidone, cellulose, water, syrups, methyl cellulose, methylhydroxy benzoate, propylhydroxy benzoate, talc, magnesium stearate, and mineral oils, but not limited to. A composition containing a water-forming NADH or NADPH oxidase according to the invention may further include a lubricant, a humectant, a sweetener, a flavoring agent, an emulsifier, a suspending agent, and a preservative. Details of suitable pharmaceutically acceptable carriers and formulations can be found in *Remington's Pharmaceutical Sciences* (19th ed., 1995), which is incorporated herein by reference.

Pharmaceutical compositions of the invention may include more than one active agent. For instance, a fusion protein of the invention may contain a water-forming NADH or NADPH oxidase conjugated to another pharmaceutically active molecule, such as those described herein. Pharmaceutical compositions of the invention may optionally include more than one active compound. For instance, a water-forming NADH or NADPH oxidase or therapeutic fusion protein thereof, polynucleotide encoding a water-forming NADH or NADPH oxidase, vector containing such a polynucleotide, or mammalian cell that expresses a water-forming NADH or NADPH oxidase may be admixed with one or more additional active agents that can be used to treat mitochondrial dysfunction or oxidative stress. Alternatively, pharmaceutical compositions of the invention may be formulated for co-administration with one or more additional active agents that can be used to treat mitochondrial dysfunction or oxidative stress. Examples of additional active agents that can be used to treat mitochondrial dysfunction or oxidative stress and that can be conjugated to, admixed with, or administered separately from include antioxidants, such as glutathione and detoxification enzymes (e.g., UDP-glucuronosyltransferases, sulfotransferases, phenol-O-methyltransferase, catechol-O-methyltransferase, histamine N-methyltransferase, nicotinamide N-methyltransferase, thiopurine methyltransferase, thiol methyltransferase, N-acetyltransferases, 0-acetyltransferases, acyl-CoA synthetases, acyl-CoA:amino acid N-acyltransferases, aminoacyl-tRNA synthetases, glutathione synthetases, gamma glutamylcysteine synthetases, glutathione S-transferases, quinone reductases, heme oxygenases, rhodaneses, glutathione reductase, glutathione peroxidase, catalase and superoxide dismutase, the uses of which are described in detail in U.S. Pat. No. 8,709,406, the teachings of which are incorporated herein by reference).

Additional active agents that may be used in the treatment of oxidative stress induced by dysfunction of the mitochondrial respiratory chain and may be conjugated to, admixed with, or administered separately from a water-forming NADH or NADPH oxidase include cerium oxide nanoparticles (nanoceria). Such nanoparticles have been shown to promote cell survival in cultured brain cells exposed to lethal concentrations of reactive oxygen species. Efficacious formulations of nanoceria are described in detail in WO 2013/187980, the teachings of which are incorporated herein by reference.

Other active agents that can be used for the treatment of mitochondrial respiratory chain dysfunction and may be conjugated to, admixed with, or administered separately from a water-forming NADH or NADPH oxidase include pyrimidine nucleotide precursors. These compounds provide a source of important substrates for DNA synthesis that are often not capable of being robustly produced endogenously under conditions in which, for instance, the ratio of mitochondrial NADH to NAD$^+$ is elevated. Examples of pyrimidine nucleotide precursors include uridine, cytidine, an acyl derivative of uridine, an acyl derivative of cytidine, orotic acid, an alcohol ester of orotic acid, or a pharmaceutically acceptable salt thereof. These compounds are described in detail in WO 2000/11952, the teachings of which are incorporated herein by reference.

Preferably the active agents (e.g., those described above) have complementary activities that do not adversely affect each other. For example, it may be desirable to further provide an immunosuppressive agent to the patient so as to attenuate the immune response against a water-forming NADH or NADPH oxidase or in order to prevent allograft rejection upon administration of human cells (e.g., allogeneic cells) expressing water-forming NADH or NADPH oxidases.

The active ingredients may also be entrapped in microcapsules prepared, for example, by coacervation techniques or by interfacial polymerization, for example, hydroxymethylcellulose or gelatin-microcapsule and poly-(methylmethacylate) microcapsule, respectively, in colloidal drug delivery systems (for example, liposomes, albumin microspheres, microemulsions, nano-particles and nanocapsules) or in macroemulsions. Such techniques are disclosed in Remington's Pharmaceutical Sciences 16th edition, Osol, A. Ed. (1980).

The formulations of water-forming NADH or NADPH oxidases to be used for in vivo administration may be sterile. This is readily accomplished, e.g., by filtration through sterile filtration membranes or other methods known in the art.

Sustained-release formulations of water-forming NADH or NADPH oxidases may also be prepared. Suitable examples of sustained-release preparations include semipermeable matrices of solid hydrophobic polymers containing the enzyme, which matrices are in the form of shaped articles, e.g., films, or microcapsule. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and γ ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxybutyric acid.

Routes of Administration

Compositions containing a water-forming NADH or NADPH oxidase (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) may be administered, and formulated for administration, by any route appropriate for therapy of the subject, such as orally, parenterally, intravenously, intramuscularly, by inhalation, intraperitoneally, intraarterially, transdermally, sublingually, nasally, transbuccally, liposomally, adiposally, opthalmically, intraocularly, subcutaneously, intrathecally, topically, or locally. By parenteral administration it is meant that a pharmaceutical composition of the invention may be administered by intravenous, subcutaneous, intramuscular, intraperitoneal, endothelial, local, spleen, pulmonary or rectal administration. For oral administration, active ingredients of oral compositions can be coated or formulated so as to be protected from hydrolysis in the stomach.

Water-forming NADH or NADPH oxidases (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) can be administered to a patient in order to ameliorate systemic mitochondrial dysfunction using any of the routes of administration described herein. Optionally, water-forming NADH or NADPH oxidases can be administered to a patient so as to direct the therapy to a particular organ. For instance, it may be desirable to target water-forming NADH or NADPH oxidases to the muscles in a patient suffering from muscular atrophy due to a dysfunctional respiratory chain. Targeted administration of water-forming NADH or NADPH oxidases can be achieved by direct administration of the therapy (e.g., water-forming NADH or NADPH oxidases, polynucleotides encoding these enzymes, human cells that have been modified to express these enzymes, etc.) to the muscle tissue by intramuscular injection of a pharmaceutically acceptable formulation containing the water-forming NADH or NADPH oxidase. Alternatively, the enzymes can be modified by covalent attachment of a molecule that selectively recognizes molecular epitopes that are prevalent in particular organs (e.g., muscles, lungs, pancreas, liver, kidneys, intestines, brain, etc.) so as to achieve a high local concentration of the enzymes to the target organ following systemic administration. Examples of such molecules that can be used to promote organ-specific enzyme delivery include antibodies that selectively recognize antigens expressed on the surfaces of muscle fibers and carbohydrates that modulate cellular adhesion. Alternatively, water-forming NADH or NADPH oxidases can be encapsulated within a larger supramolecular complex (e.g., a liposome, nanoparticle, microparticle, etc) and the exterior surface of the complex can be covalently conjugated to a molecule capable of binding and adhering to an organ-specific epitope. Exemplary ligands that can be conjugated to a water-forming NADH or NADPH oxidase or a supramolecular complex containing a water-forming NADH or NADPH oxidase so as to target the therapeutic to a particular organ are described in detail in, e.g., WO 1987/00715, the teachings of which are incorporated herein by reference. In another example, water-forming NADH of NADPH oxidases can be targeted to the brain of a patient suffering from mitochondrial defect by conjugating the enzyme or a complex containing the enzyme to distearoylphosphatidylethanolamine-polyethylene glycol-maleimide, a moiety that has been shown to effectively translocate therapeutic compounds across the blood-brain barrier in order to delivery these agents to the brain. This procedure is described in detail in EP 2308514, the teachings of which are incorporated herein by reference.

A suitable dose of a pharmaceutical composition of the invention may vary depending on pharmaceutical formulation methods, administration methods, the patient's age, body weight, sex, severity of diseases, diet, administration time, administration route, an excretion rate and sensitivity for a used pharmaceutical composition. For instance, a pharmaceutical composition of the invention may be administered in a daily dose in the range of 0.001-100 mg/kg (body weight). The dose may be administered one or more times (e.g., 2-10 times) per day, week, month, or year to a patient (e.g., a human patient) in need thereof.

According to conventional techniques known to those skilled in the art, the pharmaceutical composition may be formulated with a pharmaceutically acceptable carrier and/or vehicle as described above, and in any one of several different forms, including a unit dose form and a multi-dose form. The composition may be formulated in oil or aqueous media, as a resuspension or emulsion, extract, powder, granule, tablet, or capsule, and/or may further comprise a dispersant or stabilizer.

Water-Forming NADH or NADPH Oxidases as a Research Tool for Analyzing Respiratory Chain Activity In addition to the therapeutic applications described above, the water-forming NADH or NADPH oxidases described above (for instance, a water-forming NADH oxidase having the amino acid sequence of any one of SEQ ID NOs: 1-273, such as a water-forming NADH oxidase having the amino acid sequence of any one of SEQ ID NOs: 1-5, or a water-forming NADPH oxidase having the amino acid sequence of SEQ ID NO: 329 or 330) can be used as a research tool for understanding the molecular biology that underlies human disease, e.g., diseases and conditions caused by defects in the mitochondrial respiratory chain. One of the longstanding challenges to analyzing mitochondrial respiratory chain activity stems from the dual functions that the complexes of the chain perform. A deficiency in one or more components of the respiratory chain can cause a reduction in ATP production, the principle source of energy for cellular metabolism, and a halt in $NAD^+$ regeneration, which is chiefly responsible for vital oxidative processes, such as nucleotide biosynthesis and glucose catabolism. Water-forming NADH or NADPH oxidases from lower-order organisms and variants thereof (e.g., as described herein) provide a means for studying the activity of a mammalian cell that exhibits diminished ATP production due to a defective mitochondrial respiratory chain but that is capable of regenerating $NAD^+$. This invention therefore provides tools for studying mitochondrial activity, e.g., in cells, animal models, and in patients suffering from diseases associated with respiratory chain deficiencies, in order to more fully understand the molecular etiology that underlies mitochondrial diseases and conditions.

In order to study the effect of water-forming NADH or NADPH oxidases on a mammalian cell, a target mammalian cell can be engineered to express one or more of these enzymes using any of the gene expression techniques discussed above. Alternatively, a water-forming NADH or NADPH oxidase can be delivered into a mammalian cell directly. Exemplary tools for translocating these proteins across the mammalian cell membrane include the encapsulation of the protein into a liposome, nanoparticle, or nanosphere, as described above. Additionally, water-forming NADH or NADPH oxidases can be modified according to a variety of methods in order to append molecules that aid in the detection, visualization, purification, or organelle-specific delivery of these enzymes. These modifications are disclosed in detail in the sections that follow.

Conjugates and Fusion Proteins Containing Water-Forming NADH Oxidases

In order to analyze the activity of water-forming NADH or NADPH oxidases (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) in a mammalian system, it may be desirable to conjugate these enzymes to other molecules in order to form conjugates or fusion proteins. Water-forming NADH or NADPH oxidases can be conjugated to other molecules at either the N-terminus or C-terminus of the enzyme using any one of a variety of established conjugation strategies that are well-known in the art. Examples of pairs of reactive functional groups that can be used to covalently tether a water-forming NADH or NADPH oxidase to another molecule include those previously described, such as thiol pairs, carboxylic acids and amino groups, ketones and amino groups, aldehydes and amino groups, thiols and alpha, beta-unsaturated moieties (such as maleimides or dehydroalanine), thiols and alpha-halo amides, carboxylic acids and hydrazides, aldehydes and hydrazides, and ketones and hydrazides.

Water-forming NADH or NADPH oxidases (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) can be covalently appended directly to another molecule by a chemical conjugation as described. Alternatively, fusion proteins containing water-forming NADH or NADPH oxidases can be expressed recombinantly from a cell (e.g., a mammalian cell). This can be accomplished, for example, by incorporating a polynucleotide encoding the fusion protein into the nuclear genome of a cell using genome editing techniques, such as those described herein or known in the art. Optionally, water-forming NADH or NADPH oxidases can be joined to a second molecule indirectly by forming a covalent bond between the oxidase and a linker. This linker can then be subsequently conjugated to another molecule, or the linker can be conjugated to another molecule prior to ligation to the water-forming NADH or NADPH oxidase. Examples of linkers that can be used for the formation of a conjugate include those previously described, such as polypeptide linkers (e.g., those that contain naturally occurring or non-naturally occurring amino acids). In certain cases, it may be desirable to include D-amino acids in the linker, as these residues are not present in naturally-occurring proteins and are thus more resistant to degradation by endogenous proteases. Fusion proteins containing polypeptide linkers can be made using chemical synthesis techniques, such as those described herein, or through recombinant expression of a polynucleotide encoding the fusion protein in a cell (e.g., a mammalian cell). Linkers can be prepared using a variety of strategies that are well known in the art, and depending on the reactive components of the linker, can be cleaved by enzymatic hydrolysis, photolysis, hydrolysis under acidic conditions, hydrolysis under basic conditions, oxidation, disulfide reduction, nucleophilic cleavage, or organometallic cleavage (Leriche, et al., Bioorg. Med. Chem., 20:571-582, 2012).

In certain cases, water-forming NADH or NADPH oxidases (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) may be conjugated to another molecule (e.g., an epitope tag) for the purpose of purification or detection. Examples of such molecules that are useful in protein purification include those that present structural epitopes capable of being recognized by a second molecule. This is a common strategy that is employed in protein purification by affinity chromatography, in which a molecule is immobilized on a solid support and exposed to a heterogeneous mixture containing a target protein conjugated to a molecule capable of binding the immobilized compound. Examples of epitope tag molecules that can be conjugated to water-forming NADH or NADPH oxidases for the purposes of molecular recognition include, without limitation, maltose-binding protein, glutathione-S-transferase, a poly-histidine tag, a FLAG-tag, a myc-tag, human influenza hemagglutinin (HA) tag, biotin, streptavidin. Conjugates containing the epitopes presented by these molecules are capable of being recognized by such complementary molecules as maltose, glutathione, a nickel-containing complex, an anti-FLAG antibody, an anti-myc antibody, an anti-HA antibody, streptavidin, or biotin, respectively. For example, one can purify a water-forming NADH oxidase for use in the compositions and methods of the invention that has been conjugated to an epitope tag from a complex mixture of other proteins and biomolecules (e.g., DNA, RNA, carboyhydrates, phospholipids, etc) by treating the mixture with a solid phase resin containing an complementary molecule that can selectively recognize and bind the epitope tag of the water-forming NADH or NADPH oxidase. Examples of solid phase resins include agarose beads, which are compatible with purifications in aqueous solution.

Water-forming NADH or NADPH oxidases (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) can additionally be covalently conjugated to molecules that localize to a particular sub-cellular location, such as a specific organelle. Examples of organelles to which the water-forming NADH or NADPH oxidase can be targeted include the mitochondria, nucleus, golgi, endoplasmic reticulum, lysosome, peroxisome, and adiposome. In order to achieve targeting of a water-forming NADH or NADPH oxidase to the mitochondria, it is known in the art that one can covalently bind the oxidase to a mitochondrial targeting sequence (MTS) derived from any mitochondrial protein that is produced outside of the mitochondria. Prediction of the MTS from a given protein is routine in the art, and methods describing the prediction of such sequences are described in Claros, et al., Eur. J. Biochem., 241:779-786, 1996, the teachings of which are incorporated herein by reference. Additional examples of mitochondrial targeting sequences that can be conjugated to a water-forming NADH or NADPH oxidase include those provided in SEQ ID NOs: 298-315, described above. Additionally, water-forming NADH or NADPH oxidases can be covalently tethered to nuclear localization sequences (NLSs) in order to localize these enzymes to the nucleus of a mammalian cell. Identification of NLSs from known eukaryotic proteins that are naturally transported to the nucleus has been described Cokol, et al., EMBO Rep., 1:411-415, 2000, the teachings of which are incorporated herein by reference.

It may be desirable to direct a water-forming NADH or NADPH oxidase for use in the compositions and methods of the invention (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) to a particular cellular location in order to study the effects of the enzyme on biochemical pathways that occur exclusively in a specific organelle. For example, one can conjugate a water-forming NADH or NADPH oxidase for use in the compositions and methods of the invention to a MTS peptide and subsequently expose this conjugate to mammalian cells that exhibit a defective mitochondrial respiratory chain. Alternatively, the conjugate containing the water-forming NADH or NADPH oxidase and the MTS sequence can be expressed in a mammalian cell using any of the gene expression techniques described herein. Mammalian cells that have been treated with the conjugate or that express the conjugate can then be analyzed to determine the effect of the enzyme on mitochondrial activity. For instance, one can determine the effect of the enzyme on cell proliferation by monitoring such metrics as cell viability, the distribution of cells across the G1, S, G2, and M stages of the cell cycle, or cell morphology according to established protocols known in the art.

In order to improve the bioavailability of water-forming NADH or NADPH oxidases (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof), these enzymes can be conjugated to molecules that facilitate the transport of protein therapeutics across the cell membrane. Examples of such molecules include cell-penetrating peptides (CPPs), such as those described above. One can conjugate a water-forming NADH or NADPH oxidase to a CPP by covalently joining a reactive functional group of the enzyme (such as the N-terminal amine or C-terminal carboxylate) to an appropriate chemical moiety of the CPP molecule. This can be accomplished using established bond forming procedures known in the art. One can expose conjugates containing a water-forming NADH or NADPH oxidase and a CPP to mammalian cells in order to enhance the uptake of the enzymes by cells in vitro. Such conjugates can be used for studying the effect of water-forming NADH or NADPH oxidases on mammalian cells under various conditions, such as at a reduced temperature or cell starvation. Many CPPs are capable of penetrating the cell membrane in an energy-independent fashion. As such, a water-forming NADH or NADPH oxidase conjugated to a CPP can be exposed to cultured mammalian cells at low temperatures (such as 2-5° C.) or under conditions in which concentrations of nutrients in the culture media are diminished so as to analyze the effect of water-forming NADH or NADPH oxidases on metabolic activity under these conditions. The activity of such cells can be analyzed by any of a variety of methods. For instance, one can determine the concentration of intermediates in the citric acid cycle or glycolysis in order to understand the effect of these enzymes on glucose metabolism under such conditions. Alternatively, one can use quantitative polymerase chain reaction-based (PCR) techniques known in the art to evaluate the effects of water-forming NADH or NADPH oxidases on gene expression levels under these conditions. One can additionally probe the viability of cells after treatment with water-forming NADH or NADPH oxidases conjugated to CPPs by measuring the quantity of live cells in a particular culture using established methods known in the art, including analysis of cell count by microscopy via trypan blue dye exclusion.

In specific studies, it can be useful to covalently append a water-forming NADH or NADPH oxidase (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) to a fluorescent molecule for the purposes of detection of the NADH or NADPH oxidase by fluorimetry and/or by direct visualization using fluorescence microscopy. Exemplary fluorescent molecules that can be conjugated to these oxidases include green fluorescent protein, cyan fluorescent protein, yellow fluorescent protein, red fluorescent protein, phycoerythrin, allophycocyanin, hoescht, 4',6-diamidino-2-phenylindole (DAPI), propidium iodide, fluorescein, coumarin, rhodamine, tetramethylrhoadmine, and cyanine. Additional examples of fluorescent molecules suitable for conjugation to the NADH or NADPH oxidases of the invention are well-known in the art and have been described in detail in, e.g., U.S. Pat. Nos. 7,417,131 and 7,413,874, each of which is incorporated by reference herein.

Water-forming NADH or NADPH oxidases containing a fluorescent molecule are particularly useful for monitoring the sub-cellular localization of these enzymes. For instance, one can expose cultured mammalian cells to water-forming NADH or NADPH oxidases for use in the compositions and methods of the invention that have been covalently conjugated to a fluorescent molecule and subsequently analyze these cells using conventional fluorescent microscopy techniques known in the art. Confocal fluorescent microscopy is a particularly powerful method for determining sub-cellular localization of water-forming NADH or NADPH oxidases, as individual planes of a mammalian cell can be analyzed in order to distinguish enzymes that are located in a cell's interior from those that are bound to the external face of the cell membrane. Additionally, cells can be treated with water-forming NADH or NADPH oxidases conjugated to a fluorescent molecule that emits visible light of a particular wavelength (e.g., fluorescein, which fluoresces at about 535 nm) and an additional fluorescent molecule that is known to localize to a particular organelle and that fluoresces at a different wavelength (e.g., MITOTRACKER® Red, Life Technologies, which fluoresces at about 599 nm). The resulting emission patterns can be visualized by confocal fluorescence microscopy and the images from these two wavelengths can be merged in order to reveal information regarding the location of the water-forming NADH or NADPH oxidase in the cell with respect to other organelles.

Bioluminescent proteins can also be incorporated into a fusion protein for the purposes of detection and visualization of a water-forming NADH or NADPH oxidase (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof). Bioluminescent proteins, such as Luciferase and aequorin, emit light as part of a chemical reaction with a substrate (e.g., luciferin and coelenterazine). Exemplary bioluminescent proteins suitable for use as a diagnostic sequence and methods for their use are described in, e.g., U.S. Pat. Nos. 5,292,658, 5,670,356, 6,171,809, and 7,183,092, each of which is herein incorporated by reference. Water-forming NADH or NADPH oxidases labeled with bioluminescent proteins are a useful tool for the detection of these enzymes following an in vitro assay. For instance, the presence of a water-forming NADH or NADPH oxidase that has been conjugated to a bioluminescent protein can be detected among a complex mixture of additional proteins by separating the components of the mixture using gel electrophoresis methods known in the art (e.g., native gel analysis) and subsequently transferring the separated proteins to a membrane in order to perform a Western blot. Detection of the water-forming NADH or NADPH oxidase among the mixture of other proteins can be achieved by treating the membrane with an appropriate Luciferase substrate and subsequently visualizing the mixture of proteins on film using established protocols.

The enzymes for use in the compositions and methods of the invention can also be conjugated to a molecule comprising a radioactive nucleus, such that the NADH or NADPH oxidase (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) can be detected by analyzing the radioactive emission pattern of the nucleus. Alternatively, the water-forming NADH or NADPH oxidase can be modified directly by incorporating a radioactive nucleus within the enzyme during the preparation of these proteins. Radioactive isotopes of methionine ($^{35}$S), nitrogen ($^{15}$N), or carbon ($^{13}$C) can be incorporated in these oxidases by, e.g., culturing bacteria in media that has been supplemented with nutrients containing these isotopes. Optionally, tyrosine derivatives containing a radioactive halogen can be incorporated into a water-forming NADH or NADPH oxidase by, e.g., culturing bacterial cells in media supplemented with radiolabeled tyrosine. It has been shown that tyrosine functionalized with a radioactive halogen at the C2 position of the phenol system are rapidly incorporated into elongating polypeptide chains using the endogenous translation enzymes in vivo (U.S. Pat. No. 4,925,651, the teachings of which are incorporated herein by reference). The halogens include fluorine, chlorine, bromine, iodine, and astatine. Additionally, water-forming NADH or NADPH oxidases can be modified following isolation and purification from cell culture by functionalizing these enzymes with a radioactive isotope. The halogens represent a class of isotopes that can be readily incorporated into a purified protein by aromatic substitution at tyrosine or tryptophan, e.g., via reaction of one or more of these residues with an electrophilic halogen species. Examples of radioactive halogen isotopes include $^{18}$F, $^{75}$Br, $^{77}$Br, $^{122}$I, $^{123}$I, $^{124}$I, $^{125}$I, $^{129}$I, $^{131}$I, or $^{211}$At.

Another alternative strategy for the incorporation of a radioactive isotope is the covalent attachment of a chelating group to the water-forming NADH or NADPH oxidase (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof). Chelating groups can be covalently appended to a water-forming NADH or NADPH oxidase by attachment to a reactive functional group, such as a thiol, amino group, alcohol, or carboxylic acid. The chelating groups can then be modified to contain any of a variety of metallic radioisotopes, including, without limitation, such radioactive nuclides as $^{125}$I, $^{67}$Ga, $^{111}$In, $^{99}$Tc, $^{169}$Yb, $^{186}$Re, $^{123}$I, $^{124}$I, $^{125}$I, $^{131}$I, $^{99m}$Tc, $^{111}$In, $^{64}$Cu, $^{67}$Cu, $^{186}$Re, $^{188}$Re, $^{177}$Lu, $^{90}$Y, $^{77}$As, $^{72}$As, $^{86}$Y, $^{89}$Zr, $^{211}$At, $^{212}$Bi, $^{213}$Bi, or $^{225}$Ac.

In certain cases, it may be desirable to covalently conjugate a chelating group capable of binding a metal ion from heavy elements or rare earth ions, such as $Gd^{3+}$, $Fe^{3+}$, $Mn^{3+}$, or $Cr^{2+}$, to a water-forming NADH or NADPH oxidase (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof). Conjugates containing chelating groups that are coordinated to such paramagnetic metals are useful in MRI imaging applications. Paramagnetic metals include, but are not limited to, chromium (III), manganese (II), iron (II), iron (III), cobalt (II), nickel (II), copper (II), praseodymium (III), neodymium (III), samarium (III), gadolinium (III), terbium (III), dysprosium (III), holmium (III), erbium (III), and ytterbium (III). In this way, water-forming NADH or NADPH oxidases can be detected by MRI spectroscopy. This represents a useful tool for analyzing the absorption and distribution of these enzymes, for example, in pre-clinical assays in animal models of mitochondrial disease (Wallace, Methods Mol. Biol., 197:3-54, 2002). For instance, one can treat a subject (e.g., a mouse model of mitochondrial disease) with a water-forming NADH or NADPH oxidase conjugated to a molecule containing a chelating group that is bound to a paramagnetic ion. The mouse can subsequently be analyzed by MRI in order to determine the distribution of the enzyme within the mouse. These studies can be performed in order to reveal information pertaining to the primary sites of metabolism of these enzymes in vivo, and the results of these experiments can inform the design of water-forming NADH or NADPH oxidases that have been modified in order to improve metabolic stability.

Water-forming NADH or NADPH oxidases for use in the compositions and methods of the invention (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) can also be conjugated to a cytotoxic agent in order to study the pathophysiology of a cell proliferation disease in mammalian cells that also exhibit a mitochondrial defect. For example, a water-forming NADH or NADPH oxidase can be covalently joined to any of the previously described cytotoxic agents, and the resulting conjugate can subsequently be administered to cultured mammalian cells that display diminished respiratory chain activity and have escaped cell cycle controls. In this way, the effect of the conjugate on such cells can be monitored by determining the viability of the cultured cells after exposure to the conjugate. Alternatively, one can determine the concentration of metabolites that are produced by these cells in response to the conjugate, as an increase or decrease in the content of certain biomolecules can provide insight into the biochemical pathways that are perturbed by introduction of the conjugate. Exemplary metabolites that can be analyzed in response in response to treatment of cultured mammalian cells with conjugates containing water-forming NADH or NADPH oxidases include $NAD^+$, $NADP^+$, NADH, NADPH, FAD, $FADH_2$, PDH, pyruvate, lactate, ethanol, glucose, oxaloacetate, fumarate, succinate, and alpha-ketoglutarate, among others. This analysis would enable one to correlate particular water-forming NADH or NADPH oxidase-containing conjugates with distinct pathways that may be aberrantly regulated in certain disease states.

Kits Containing Water-Forming NADH or NADPH Oxidases

This invention also includes kits that contain water-forming NADH or NADPH oxidases (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof). The kits provided herein may contain any of the water-forming NADH or NADPH oxidases described above, as well as any of the polynucleotides encoding these enzymes, vectors encoding these polynucleotides, or mammalian cells engineered to express these enzymes. A kit of this invention may include reagents that can be used to produce the compositions of the invention (e.g., water-forming NADH or NADPH oxidases, fusion proteins containing water-forming NADH or NADPH oxidases, polynucleotides encoding water-forming NADH or NADPH oxidases, vectors containing these polynucleotides, mammalian cells that express water-forming NADH or NADPH oxidases, etc). Optionally, kits of the invention may include reagents that can induce the expression of water-forming NADH or NADPH oxidases within mammalian cells, such as doxycycline or tetracycline. In other cases, a kit of the invention contains a compound capable of binding and detecting a fusion protein that contains a water-forming NADH or NADPH oxidase and an epitope tag. For instance, in such cases a kit of the invention may contain maltose, glutathione, a nickel-containing complex, an anti-FLAG antibody, an anti-myc antibody, an anti-HA antibody, biotin, or streptavidin.

Kits of the invention may also include reagents that are capable of detecting a water-forming NADH or NADPH oxidase (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof). Examples of such reagents include primary antibodies that selectively recognize and bind particular structural epitopes of a water-forming NADH or NADPH oxidase. These reagents can be used for the detection and visualization of a water-forming NADH or NADPH oxidase, for instance, by performing an immunoblot according to procedures known in the art. Kits of the invention may also contain primary antibodies that selectively recognize a water-forming NADH or NADPH oxidase and that are conjugated to a fluorescent molecule. These antibody-fluorophore conjugates provide a tool for analyzing the localization of water-forming NADH or NADPH oxidases, e.g., in a particular tissue or cultured mammalian cell using established immunofluorescence techniques. In certain cases, kits of the invention may include additional fluorescent compounds that exhibit known sub-cellular localization patterns. These reagents can be used in combination with an antibody-fluorophore conjugate, such as those described above, in order to identify the specific organelles and cellular structures to which a water-forming NADH or NADPH oxidase localizes.

In other cases, a kit of the invention may also contain reagents useful for analyzing an effect of water-forming NADH or NADPH oxidase activity in a mammalian cell or within a specific organelle within said mammalian cell. The effect that can be studied using such a kit can be a change in the ratio of $NAD^+$ to NADH or NADPH, a change in the ratio of lactate to pyruvate, a change in the rate of gluconeogenesis, or a change in the phosphorylation state of PDH in a mammalian cell or in a specific organelle within a mammalian cell.

Kits of the invention may also contain a reagent that can be used for the analysis of a metabolite or other biomolecule in a mammalian cell following treatment with a water-forming NADH or NADPH oxidase of the invention (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof). For instance, a kit may include a primary antibody that selectively recognizes an endogenous protein within a mammalian cell, such as, e.g., a protein involved in cell proliferation, gene expression, protein translation, cell cycle control, glucose metabolism, nucleotide biosynthesis, or other biochemical pathways. The components of this kit can be used to determine the effect of a water-forming NADH or NADPH oxidase on the intracellular concentrations of these molecules. For instance, using the kit, one can expose a mammalian cell exhibiting deficient respiratory chain activity to a water-forming NADH or NADPH oxidase and subsequently monitor the levels of other cellular proteins by performing a Western blot according to established protocols known in the art. Antibodies provided in such a kit may additionally include secondary antibodies that recognize the previously described primary antibody and that is in turn conjugated to an additional molecule for the purposes of visualization. Examples of secondary antibodies useful for the detection and visualization of primary antibodies include those that are conjugated to enzymes that generate visible light. This light can be due to luminescence of a product of the chemical reaction catalyzed by such an enzyme. Preferred secondary antibodies include those conjugated to such enzymes as horseradish peroxidase, Luciferase, and others known in the art.

A kit of the invention may also include a reagent that is capable of detecting the enzymatic activity of a water-forming NADH or NADPH oxidase (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) by detecting a product of the chemical reaction catalyzed by this enzyme. Such a kit can include a reagent capable of detecting $NAD^+$ or $NADP^+$. This can be achieved by providing a substrate, such as ethanol, that can be oxidized by $NAD^+$ or $NADP^+$, and an enzyme capable of catalyzing this oxidation, such as alcohol dehydrogenase. This provides a means of chemically detecting the level of $NAD^+$ or $NADP^+$ in a biological sample, since the oxidation of ethanol to acetaldehyde requires a minimum amount of $NAD^+$ or $NADP^+$ present in the sample and increases in proportion to the concentration of $NAD^+$ or $NADP^+$ available. The kit can provide another reagent capable of being reduced by the NADH or NADPH that is generated by this process, as well as an enzyme capable of reducing this reagent to one that can be detected visually or spectrophotometrically by monitoring the absorption of a specific wavelength of visible light by the solution. Examples of a compatible substrate that can be reduced by NADH or NADPH include a tetrazolium salt, such as tetrazolium chloride. A diaphorase enzyme catalyzes the reduction of tetrazolium salts to formazan, an aromatic, highly-colored dye that is readily detectable by spectrophotometry.

A kit of the invention may also contain a vector containing a polynucleotide that encodes a water-forming NADH or NADPH oxidase (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof), such as any of the vectors described herein (e.g., a viral vector, such as a lentiviral vector, adenoviral vector, or AAV vector, among others). Alternatively, a kit may include mammalian cells that have been genetically altered to express water-forming NADH or NADPH oxidases from the nuclear genome of the cell. Such a kit may also contain instructions describing how expression of the water-forming NADH or NADPH oxidase gene can be induced, and may additionally include reagents (such as, e.g., doxycycline or tetracycline) that can be used to promote the transcription of these genes.

Kits of the invention may also contain reagents that can be conjugated to a water-forming NADH or NADPH oxidase (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof), including those previously described (e.g., a cell-penetrating peptide, an organelle-targeting molecule, a fluorescent molecule, a bioluminescent molecule, a molecule containing a radioactive isotope, a molecule containing a chelating group bound to a paramagnetic ion, a cytotoxic agent, etc). These kits may additionally contain instructions for how the conjugation of a water-forming NADH or NADPH oxidase of the invention to a second molecule, such as those described above, can be achieved.

Other kits of the invention may include tools for engineering a mammalian cell (e.g., a human cell) so as to express a water-forming NADH or NADPH oxidase (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof) from the nuclear genome of the cell. For example, a kit may contain mammalian cells stored in an appropriate media and optionally frozen according to methods known in the art. The kit may also provide a vector containing a polynucleotide that encodes a nuclease (e.g., such as the CRISPER/Cas, zinc finger nuclease, TALEN, ARCUS™ nucleases described herein) as well as reagents for expressing the nuclease in the cell. The kit can additionally provide tools for modifying the polynucleotide that encodes the nuclease to enable one to alter the DNA sequence of the nuclease in order to direct the cleavage of a specific target DNA sequence of interest. Examples of such tools include primers for the amplification and site-directed mutagenesis of the polynucleotide encoding the nuclease of interest. The kit may also include restriction enzymes that can be used to selectively excise the nuclease-encoding polynucleotide from the vector and subsequently re-introduce the modified polynucleotide back into the vector once the user has modified the gene. Such a kit may also include a DNA ligase that can be used to catalyze the formation of covalent phosphodiester linkages between the modified nuclease-encoding polynucleotide and the target vector.

The kit may also provide a polynucleotide encoding a water-forming NADH or NADPH oxidase (for instance, a water-forming NADH oxidase having the amino acid sequence of any one of SEQ ID NOs: 1-273 and variants thereof, such as a water-forming NADH oxidase having the amino acid sequence of any one of SEQ ID NOs: 1-5, or a water-forming NADPH oxidase having the amino acid sequence of SEQ ID NO: 329 or 330 and variants thereof), as well as a package insert describing the methods one can use to selectively cleave a particular DNA sequence in the genome of the cell in order to incorporate the polynucleotide encoding a water-forming NADH or NADPH oxidase into the genome at this site. Optionally, the kit may provide a polynucleotide encoding a fusion protein that contains a water-forming NADH or NADPH oxidase and an additional polypeptide, such as, e.g., those described herein.

EXAMPLES

The following examples are put forth so as to provide those of ordinary skill in the art with a description of how the compositions and methods claimed herein are performed, made, and evaluated, and are intended to be purely exemplary for use in the compositions and methods of the invention and are not intended to limit the scope of what the inventors regard as their invention.

Example 1. Materials and Methods

Cell Culture Reagents

Oligomycin A, antimycin A, doxycycline, nicotinamide mononucleotide (PMN), FAD, $NAD^+$, NADH, $NADP^+$, NADPH, AMP, ADP, ATP, malate, sodium dithionite and oxaloacetate were purchased from Sigma. Piericidin A was from Santa Cruz Biotechnlogy. PJ34 was from Tocris. Hoechst 33345 was from Life Technologies.

Formulations of cell culture media used in this study are listed in Table 3. HeLa cells were purchased from ATCC (CCL-2) and were cultured in Dulbecco's modified Eagle's medium (DMEM (US Biological, D9800), 3.7 g/L $NaHCO_3$, 10% dialyzed FBS (Life Technologies, 26400-044)). HEK293T cells were purchased from ATCC (CRL-11268) and were cultured in DMEM (High glucose DMEM containing $NaHCO_3$ (Life Technologies, 11995) and 10% FBS (Sigma, F2442)). Lentiviral infected HeLa cells were cultured in DMEM (DMEM (US Biological, D9800), 3.7 g/L $NaHCO_3$, 10% dialyzed FBS (Life Technologies, 26400-044))±200 µg/ml geneticin (Life Technologies, 10131-035) ±1 µg/ml puromycin (Life Technologies, A1113803). All of the experiments were performed in the absence of geneticin and puromycin.

TABLE 3

Formulations of cell culture media

| | DMEM US Biological D9800 g/L | DMEM US Biological D9800-02 g/L | DMEM US Biological D9802 g/L | DMEM Life Technologies 11995 g/L | DMEM Life Technologies A14430 g/L |
|---|---|---|---|---|---|
| Inorganic Salts: | | | | | |
| Calcium Chloride•2H2O | 0.265 | 0.265 | 0.265 | 0.200 CaCl2(anhyd.) | 0.200 CaCl2(anhyd.) |
| Ferric Nitrate•9H2O | 0.0001 | 0.0001 | 0.0001 | 0.0001 | 0.0001 |
| Magnesium Sulfate | 0.09767 | 0.09767 | 0.09767 | 0.09767 | 0.09767 |
| Potassium Chloride | 0.4 | 0.4 | 0.4 | 0.4 | 0.4 |
| Sodium Chloride | 6.4 | 6.4 | 6.4 | 6.4 | 6.4 |
| Sodium Phosphate Monobasic | 0.109 | 0.109 | 0.109 | 0.125 NaH2PO4—H2O | 0.125 NaH2PO4—H2O |
| Sodium Bicarbonate (NaHCO3) | Absent | Absent | Absent | 3.7 | 3.7 |
| Amino Acids: | | | | | |
| L-Arginine•HCl | 0.084 | 0.084 | 0.084 | 0.084 | 0.084 |
| L-Cystine•2HCl | 0.0626 | 0.0626 | 0.0626 | 0.063 | 0.063 |
| L-Glutamine | 0.584 | Absent | 0.584 | 0.584 | Absent |
| Glycine | 0.03 | 0.03 | 0.03 | 0.03 | 0.03 |
| L-Histidine•HCl•H2O | 0.042 | 0.042 | 0.042 | 0.042 | 0.042 |
| L-Isoleucine | 0.105 | 0.105 | 0.105 | 0.105 | 0.105 |
| L-Leucine | 0.105 | 0.105 | 0.105 | 0.105 | 0.105 |
| L-Lysine•HCl | 0.146 | 0.146 | 0.146 | 0.146 | 0.146 |
| L-Methionine | 0.03 | 0.03 | 0.03 | 0.03 | 0.03 |
| L-Phenylalanine | 0.066 | 0.066 | 0.066 | 0.066 | 0.066 |
| L-Serine | 0.042 | 0.042 | 0.042 | 0.042 | 0.042 |
| L-Threonine | 0.095 | 0.095 | 0.095 | 0.095 | 0.095 |
| L-Tryptophan | 0.016 | 0.016 | 0.016 | 0.016 | 0.016 |
| L-Tyrosine•2Na•2H2O | 0.10379 | 0.10379 | 0.10379 | 0.104 | 0.104 |
| L-Valine | 0.094 | 0.094 | 0.094 | 0.094 | 0.094 |
| Vitamins: | | | | | |
| Choline Chloride | 0.004 | 0.004 | 0.004 | 0.004 | 0.004 |
| Folic Acid | 0.004 | 0.004 | 0.004 | 0.004 | 0.004 |
| myo-Inositol | 0.0072 | 0.0072 | 0.0072 | 0.0072 | 0.0072 |

TABLE 3-continued

Formulations of cell culture media

| | DMEM US Biological D9800 g/L | DMEM US Biological D9800-02 g/L | DMEM US Biological D9802 g/L | DMEM Life Technologies 11995 g/L | DMEM Life Technologies A14430 g/L |
|---|---|---|---|---|---|
| Niacinamide | 0.004 | 0.004 | 0.004 | 0.004 | 0.004 |
| D-Pantothenic Acid, Ca | 0.004 | 0.004 | 0.004 | 0.004 | 0.004 |
| Pyridoxal•HCl | 0.004 | 0.004 | 0.004 | 0.004 | 0.004 |
| Riboflavin | 0.0004 | 0.0004 | 0.0004 | 0.0004 | 0.0004 |
| Thiamine•HCl | 0.004 | 0.004 | 0.004 | 0.004 | 0.004 |
| Other: | | | | | |
| D-Glucose | 1 | Absent | 1 | 4.5 | Absent |
| Pyruvic Acid, Sodium | 0.11 | 0.11 | Absent | 0.11 | Absent |
| Phenol Red, Sodium | 0.0159 | 0.0159 | Absent | 0.015 | Absent |

Cloning of NOXes into pLVX-TRE3G Vector

Human codon optimized genes encoding $H_2O$-forming NADH oxidases (NOXes) from *Lactobacillus brevis* (SEQ ID NO: 316), *Lactococcus lactis* (SEQ ID NO: 317), *Streptococcus pneumoniae* (SEQ ID NO: 318), *Streptococcus mutans* (SEQ ID NO: 319), and *Serpulina hyodysenteriae* (SEQ ID NO: 320), flanked by NotI and MluI restriction sites in pUC57 vector, were custom synthesized by GENEWIZ. Above mentioned mitoNOXes constructs also included: (i) mitochondrial targeting sequence (MTS) of subunit IV of human cytochrome c oxidase (23 amino acids long, SEQ ID NO: 298) added upstream of the NOX coding sequence and (ii) a linker sequence with a FLAG-tag added in-frame downstream of the nox gene. Only MTS and the NOX coding regions were codon optimized. After digestion with NotI and MluI, inserts were directly ligated into pLVX-TRE3G vector (Clontech, CA). To remove MTS and produce constructs of untargeted NOXes, corresponding nox genes were amplified using the following primers containing restriction sites NotI and MluI shown in bold: *Lactobacillus brevis* 5'-TTA ATT GCG GCC GCATGA AGGTCA CCGTGGTCG-3' (SEQ ID NO: 321); *Lactococcus lactis* 5'-TTA ATT GCG GCC GCATGA AGATTG TCG TCA TCG-3' (SEQ ID NO: 322); *Streptococcus pneumoniae* 5'-TTA ATT GCG GCC GCATGA GCA AGATCGTGGTGG-3' (SEQ ID NO: 323); *Streptococcus mutans* 5'-TTA ATT GCG GCC GCATGA GCA AGATCG TGA TCG TC-3' (SEQ ID NO: 324); *Serpulina hyodysenteriae* 5'-TTA ATT GCG GCC GCATGA AAGTGA TCG TGA TCG-3' (SEQ ID NO: 325) and the reverse primer 5'-TTA ATT ACG CGT TTA CTT GTC ATC GTC ATC CTT GT-3' (SEQ ID NO: 326). After digestion with NotI and MluI PCR products were ligated into pLVX-TRE3G vector (Clontech, CA).

Cloning of LbNOX into pET30a

*L. brevis* nox gene was amplified from the pUC57 vector (containing *H. sapiens* codon optimized sequence) using the following primers containing restriction sites BamHI and XhoI shown in bold: 5'-TTA ATT GGA TCC ATG AAG GTC ACC GTG GTC GG-3' (SEQ ID NO: 327) and 5'-TTA ATT CTC GAG TCA CTT GTC ATC GTC ATC C-3' (SEQ ID NO: 328). After digestion PCR product was ligated into pET30a vector (EMD Millipore). The resulting construct encodes LbNOX with both the N-terminal Hisx6-tag and the C-terminal FLAG-tag.

Cloning of *S. cerevisiae* Ndi1 into pLVX-TRE3G Vector

In the construct ordered from GENEWIZ Ndi1 coding sequence was *H. sapiens* codon-usage optimized and a coding sequence for a FLAG-tag was inserted right after endogenous MTS cleavage site preceded by AgeI restriction site. The insert was cut from pUC57, and directly ligated into pLVX-TRE3G vector (Clonetech, CA) using NotI and EcoRI restriction sites.

Lentivirus Production

Half a million HEK293T cells were seeded per well in a 6-well plate (one plate per lentivirus) in 2 ml of DMEM (High glucose DMEM (Life Technologies, 11995), 10% FBS (Sigma, F2442)). Next evening media was replaced with fresh DMEM and cells were transfected with 100 µl of the transfection mixture per well. Transfection mixture contained 3 µl X-TREME™ Gene 9 reagent (Roche, 06365787001), 500 ng psPAX2 (psPAX2 was a gift from Didier Trono, Addgene plasmid #12260), 50 ng pMD2.G (pMD2.G was a gift from Didier Trono, Addgene plasmid #12259), 500 ng pLVX-TRE3G vector of interest (including pLVX-TRE3G-Luc control vector, expressing Luciferase, obtained from Clonetech) and OPTI-MEM® media (Life Technologies, 31985-070) up to 100 µl. To make the transfection mixture, 50 µl solutions of X-treme Gene 9 and DNA mixture were prepared separately and DNA solution was added dropwise to X-treme Gene 9 solution. The mixture was incubated at room temperature for 30 min before adding to cells. Two days after transfection, media was collected, centrifuged at 500×g for 5 min to pellet cells and supernatant was aliquoted and stored at −80° C.

Adenovirus Production

Two custom adenoviruses (Adenovirus Type 5 (dE1/E3)) were produced by Vector Biolabs. The same LbNOX and mitoLbNOX nucleotide sequences were used as in the lentiviral pLVX-TRE3G constructs. Adenoviral constructs encode for expression of either LbNOX or mitoLbNOX and eGFP, each gene driven by its own CMV promoter. Adenovirus with eGFP driven by the CMV promoter was used as a control (Vector Biolabs, 1060-HT).

Generation of Stable Cells Using Lentiviral Infection

Fifty thousand HeLa cells were seeded in 2 ml of DMEM (DMEM (US Biological, D9800), 3.7 g/L $NaHCO_3$, 10% dialyzed FBS (Life Technologies, 26400-044)) per well in a 6-well plate. Twenty four hours after seeding, 200 µl of lentivirus was added per well. Twenty four hours postinfection media was exchanged. After additional twenty four hours, media was exchanged to 2 ml of DMEM±200 µg/ml geneticin (Life Technologies, 10131-035)±1 µg/ml puromycin (Life Technologies, A1113803). Stable cells were selected for at least a week before performing experiments and were cultured in the presence of indicated concentrations of antibiotics.

Oxygen Consumption Rate (OCR) of Cell Lines Overexpressing NOXes and Luciferase

Oxygen consumption rates (OCR) of HeLa cells expressing 5 bacterial NOXes (untargeted and targeted to mitochondria) and Luciferase under the control of doxycycline (DOX) inducible promoter (TRE3G) were measured with the XF24 Extracellular Flux Analyzer (Seahorse Bioscience, manufactured in 2008). Cells were seeded at 30-40×10$^3$ cells per well in XF24 24-well cell culture microplates in 200 µl of DMEM (DMEM (US Biological, D9800), 3.7 g/L NaHCO$_3$ and 10% dialyzed FBS (Life Technologies, 26400-044) and were incubated at 37° C. in 5% CO$_2$ incubator. Media was replaced the next day with 1 ml per well and doxycycline (final concentration ~300 ng/ml, prepared in water) or water were added to the corresponding wells to induce protein expression. Twenty four hour later, media was replaced with 950 µL of the assay medium (no pyruvate DMEM (US Biological, D9802), 15.9 mg/L phenol red, 10% dialyzed FBS (Life Technologies, 26400-044) and 25 mM HEPES-KOH, pH 7.4) and plates were introduced into the X24 Extracellular Flux Analyzer for experimental measurements. Each measurement was performed over 4 min after a 2-min mix and a 2-min wait period. Basal measurements were collected 8 times and 4 measurements were collected after injection of oligomycin (final concentration 1 µM), followed by 4 measurements after addition of antimycin A (final concentration 1 µM) from the XF24 ports in 50 µL of the assay medium.

Antimycin- and Piericidin-Resistant OCR by LbNOX, mitoLbNOX and Luciferase

Cells were seeded at 30-40×10$^3$ per well in XF24 24-well cell culture microplates in 200 µl of normal growth media (DMEM (US Biological, D9800), 3.7 g/L NaHCO$_3$ and 10% dialyzed FBS (Life Technologies, 26400-044)) and were incubated at 37° C. in 5% CO$_2$ incubator. For all experiments the next day media was renewed with 1 ml per well and doxycycline (final concentration ~300 ng/ml) or water were added. Twenty four hours later, media was changed to no pyruvate media (no pyruvate DMEM (US Biological, D9802), 15.9 mg/L phenol red, 3.7 g/L NaHCO$_3$ and 10% dialyzed FBS (Life Technologies, 26400-044)). Two hours later, media was replaced with 950 µL of the assay medium (no pyruvate DMEM (US Biological, D9802), 15.9 mg/L phenol red, 10% dialyzed FBS (Invitrogen, 26400-044) and 25 mM HEPES-KOH, pH 7.4) and OCR was measured. Each measurement was performed over 4 min after a 2-min mix and a 2-min wait period. Basal measurements were collected 8 times and 4 measurements were collected after injection of each drug: antimycin A (final concentration 1 µM) or piericidin (final concentration 1 µM). Three measurements before and after addition of the drug were averaged and normalized by the cell number.

Expression and Purification of LbNOX

E. coli BL21 (DE3) cells (Life Technologies, C6010-03), harboring pET30a vector with the L. brevis nox gene were grown at 37° C. in six 2.8-L flasks, each containing 1 L of LB medium supplemented with 50 µg/ml kanamycin to an A$_{600}$ of 0.4-0.6. At that point, temperature was decreased to 15° C. and cells were grown for additional 2 h. After induction with 0.1 mM isopropyl 1-thio-β-d-galactopyranoside (IPTG), cells were grown for 14-16 h at 15° C.

Harvested cells were resuspended in ~150 ml of lysis buffer (50 mM Na$_2$HPO$_4$, pH 8.0, 500 mM NaCl, 20 mM imidazole) containing six protease inhibitor tablets (Roche Applied Science, 05 056 489 001), 60 µl of BENZONASE® nuclease (EMD Millipore, 71205-3), 4 mM phenylmethylsulfonyl fluoride (PMSF) (prepared in ethanol), 100 µM FAD (Sigma, F6625-100MG) and disrupted by sonication on ice (output setting of 50% for 20 min with 30 sec bursts and 59 sec breaks). Following centrifugation, the cell lysate was filtered through 0.4 µm filter and subjected to dilution to ~600 ml with lysis buffer and loaded onto a 25-ml Nickel SEPHAROSE™ 6 Fast Flow column (GE Healthcare). After washing with 15 column volumes (CV) of lysis buffer, the protein was eluted with a gradient of 20-300 mM imidazole in lysis buffer over 8 CV. Fractions containing LbNOX were pooled and exchanged into 50 mM Na$_2$HPO$_4$, pH 7.5 buffer and applied to a 30-ml Source 15Q column equilibrated with 50 mM Na$_2$HPO$_4$, pH 7.5, 50 mM NaCl buffer at flow rate of 6 ml/min. SOURCE™ 15Q resin was obtained from GE Healthcare (17-0947-01) and packed into OMNIFIT® glass column (Sigma, 56009-U). After sample was applied, the column was washed with 5 CV of equilibration buffer and eluted with 15 CV gradient 50-300 mM NaCl in 50 mM Na$_2$HPO$_4$, pH 7.5 buffer. The ion-exchange chromatography step on SOURCE™ 15Q allows separation of apoLbNOX (LbNOX which is devoid of FAD cofactor) and LbNOX partially loaded with FAD from fully reconstituted LbNOX (holoLbNOX). The fractions from the peak which corresponded to fully reconstituted LbNOX with the highest specific activity (~550 µmol min$^{-1}$ mg$^{-1}$) were pooled, concentrated and loaded onto a 120 ml HiPrep 16/60 SEPHACRYL™ S-400 column (GE Healthcare, 28-9356-04) equilibrated with 50 mM Na$_2$HPO$_4$, pH 7.5, 150 mM NaCl buffer at flow rate of 1.2 ml/min. Fractions containing LbNOX were pooled, concentrated, flash-frozen in liquid nitrogen and stored at −80° C. Ion-exchange chromatography and gel-filtration steps were performed on AKTA pure FPLC system (GE Healthcare).

To remove extra amino acids arising from the N-terminal Hisx6 tag LbNOX sample (0.5-1.5 mg) was incubated with 18-25 U of recombinant enterokinase (EMD Millipore, 69066-3) at 4° C. overnight. After cleavage with enterokinase sample was passed through His GRAVITRAP™ column (GE Healthcare, 11-0033-99), equilibrated with 50 mM Na$_2$HPO$_4$, pH 7.5, 150 mM NaCl buffer and the flow-through containing cleaved protein was collected and used in the experiments. This step provides the most active protein with the specific activity ~750 µmol min$^{-1}$ mg$^{-1}$.

Determination of the Oligomerization State

The oligomerization state of LbNOX was determined by size-exclusion chromatography. Protein was injected (0.1 ml of 10 mg/ml protein) onto a HiPrep 16/60 SEPHACRYL™ S-400 HR column (GE Healthcare) equilibrated in 50 mM Na$_2$HPO$_4$, pH 7.5, 150 mM NaCl buffer. The column was operated at a flow rate of 1.2 ml/min. LbNOX was injected onto the column 6 times, and each size-exclusion standards (GE Healthcare, 28-4038-41) 3 times that included aldolase (158 kDa), conalbumin (75 kDa), ovalbumin (44 kDa) and carbonic anhydrase (29 kDa).

Enzymatic Assays

Recombinant LbNOX activity was monitored by following the decrease of the absorbance of NAD(P)H at 340 µM using CARY® 100 spectrophotometer (Agilent, CA). A typical reaction mixture contained 2 µM FAD in 0.5 ml of the assay buffer (50 mM Na$_2$HPO$_4$, pH 7.5, 150 mM NaCl) and was incubated for 4 min at 37° C. before NAD(P)H (2-600 µM) and enzyme (0.08-6.8 µg) were added. Extinction coefficient ($\varepsilon_{340}$=6.2 mM$^{-1}$ cm$^{-1}$) was used to calculate NAD(P)H oxidase activity. Simultaneous monitoring of oxygen consumption and NADH fluorescence was performed using a custom-built fluorimeter. In our setup the REDEYE™ oxygen patch (OceanOptics) was installed in a cuvette and the optical probe was connected to a fluorimeter. Oxygen causes quenching of the REDEYE™ patch fluorescence which allows to monitor the partial pressure of oxygen. In our experiments 0.5 ml of the assay buffer was preincubated at 28° C. before NADH (40-1500 µM) and LbNOX (0.1-2 µg) were added.

UV-Visible Spectroscopy

UV-visible spectra can be recorded for water-forming NADH oxidases for use in the compositions and methods of the invention. UV-visible spectra as described in the examples herein were recorded on a CARY® 100 spectrophotometer (Agilent, CA). LbNOX (40-80 µM FAD active sites) in the assay buffer was incubated at 24° C. and (0.3-3 mM) sodium dithionite was added.

Determination of $H_2O_2$ Production by LbNOX $H_2O_2$ production was monitored in a continuous assay followed by the increase in absorbance at 570 nm upon resorufin formation ($\varepsilon_{570}$=54 mM$^{-1}$ cm$^{-1}$). It was shown previously that presence of NADH in the assay mixture results in the oxidation of AMPLEX® Red dye in the HRP-dependent manner and this process is greatly diminished by supplementation of superoxide dismutase (SOD) (Votyakova, et al., Arch. Biochem. Biophys., 431:138, 2004). Therefore in our continuous assay we used SOD to minimize background rate of resorufin production, which is not related to $H_2O_2$ production by LbNOX. Assay mixture contained 350 µM NADH, 10 µl of HRP (Abcam, ab102500), 10 µl of AMPLEX® Red (Abcam, ab102500), 100 µM D-glucose, 130 U SOD (Sigma, 13697-75 KU) in 0.5 ml of the assay buffer (50 mM Na$_2$HPO4, pH 7.5, 150 mM NaCl). The reaction was preincubated at 37° C. for 3 min before LbNOX was added (0.15 µg) and subsequently after LbNOX-dependent rate of $H_2O_2$ production was recorded, 4 U of glucose oxidase (Sigma, G2133-10 KU) was added (FIG. 6). Glucose oxidase was used to validate the assay (FIG. 6). $H_2O_2$-forming activity of LbNOX was compared to the total NADH oxidase activity which was determined in a parallel experiment when the decrease of NADH absorbance at 340 nm was monitored under identical conditions.

Enzyme-Monitored Turnover

Figure 7:
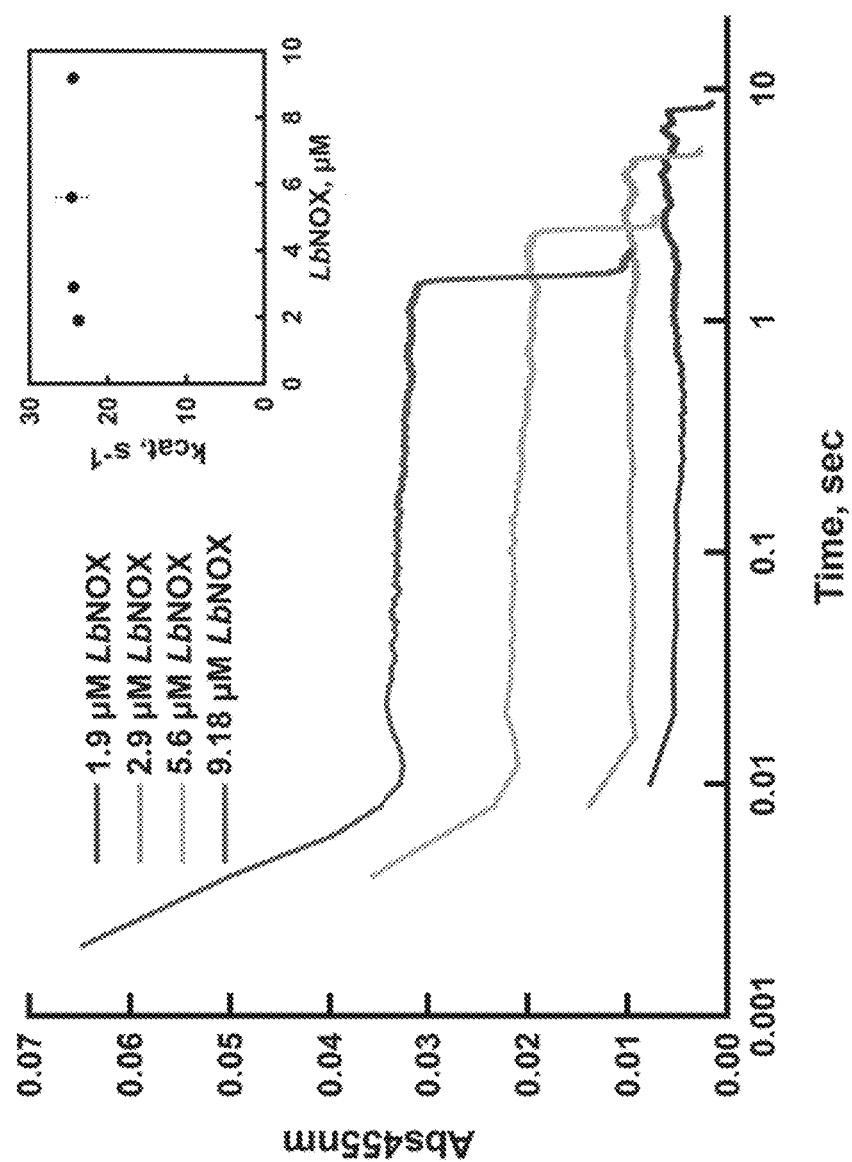
FIG. 7 shows enzyme-monitored turnover traces of LbNOX. The experiment was carried out by monitoring the time dependence of FAD oxidation state via its absorbance at 455 nm in 50 mM NaPi pH7.5 150 mM NaCl buffer at 4° C. Air-saturated LbNOX (1.9, 2.9, 5.6 and 9.18 µM FAD active sites after mixing) and air-saturated solution of NADH (2 mM after mixing). The traces at 455 nm are treated as records of the rate of catalysis as a continuous function of the concentration of $O_2$ (the limiting substrate).

The reaction of LbNOX with oxygen was studied by the enzyme-monitored turnover method (Gibson, et al., J. Biol. Chem., 239:3927, 1964; and Tapley, et al., J. Biol. Chem., 282:10263, 2007). Rapid reaction studies were carried out at 4° C. in a SX20 stopped flow instrument (Applied Photophysics, UK) equipped with a diode array detector. To follow the redox state of the FAD cofactor, LbNOX enzyme (1.9, 2.9, 5.6 and 9.18 µM FAD active sites after mixing) was mixed with NADH (2 mM after mixing), both prepared in air-saturated assay buffer (50 mM Na$_2$HPO$_4$, pH 7.5, 150 mM NaCl) and absorbance at 455 nm was monitored over time. Solubility of oxygen at 4° C. was calculated from oxygen solubility table at corresponding salinity of the assay buffer which is ~380 µM. Results represent (n=3) independent experiments. The traces at 455 nm reflect the conversion of oxidized to reduced enzyme forms and are treated as previously described (Gibson, et al., J. Biol. Chem., 239: 3927, 1964), where the area under the curve is proportional to the concentration of oxygen which is a limiting substrate under these conditions. From the traces generated at different enzyme concentrations it can be seen that the absorbance at 455 nm drops rapidly to the steady state where the signal remains constant until the rapid drop at the point where oxygen is depleted and the enzyme becomes fully reduced (FIG. 7). This last phase is very abrupt even at 1.9 µM enzyme, demonstrating that concentration of oxygen is significantly higher than the K$_M$ for oxygen even during the last turnover. We therefore estimated that apparent K$_M$ for O$_2$ to be less than 2 µM. Based on the enzyme concentration (1.9-9.18 µM) and time it took to consume O$_2$ (8.12-1.67 sec), apparent k$_{cat}$ can be calculated (FIG. 7).

Protein Crystallization and Structure Determination

Crystals of LbNOX were grown by vapor diffusion technique. For the initial screening of crystallization conditions 0.1 µl of protein solution (10 mg/ml LbNOX in 10 mM HEPES, pH 7.5 100 mM NaCl) and 0.1 µl of precipitant solution (MCSG Suite, Microlytic, MA) were mixed using the NanoTransfer NT8 pipetting robot (Formulatrix, MA) and incubated over a 50 µl reservoir in the sitting drop plates. Progress of protein crystallization was monitored with Rock Maker (Formulatrix, MA). Optimal crystals were formed in 20% PEG 3350, 0.2 M NH$_4$Cl at 21° C. For harvesting, crystals were cryoprotected by adding 20% (v/v) of ethylene glycol to the precipitant solution.

X-ray diffraction data were collected at beamline 8.2.2 at the Advanced Light Source (Berkeley, CA). Data collected at λ=1.000 Å were indexed, integrated, and scaled using the software HKL2000 (Otwinowski, et al., Meth. Enzymol., 276:307, 1997). Four molecules of LbNOX in the asymmetric unit of P1 crystal were found by molecular replacement with Phaser-MR program of PHENIX package (Bunkoczi, et al., Acta Crystallogr. Section D, Biological crystallography, 69:2276, 2013; and Adams, et al., Acta Crystallogr. Section D, Biological crystallography, 66:213, 2010) using the structure of H$_2$O-forming NAD(P)H oxidase from *Lactobacillus* sanfranciscensis (PDB ID 2CDU) as a model. The structure was refined using Phenix.refine (Adams, et al., Acta Crystallogr. Section D, Biological crystallography, 66:213, 2010) and/or refmac5 in the CCP4 suite (Winn, et al., Acta Crystallogr. Section D, Biological crystallography, 67:235, 2011), and manually using COOT (Emsley et al., Acta Crystallogr. Section D, Biological crystallography, 60:2126, 2004). Oxygen and FAD molecules were added in later rounds of refinement. The final protein model contained all residues except for the N-terminal Hisx6 tag and the C-terminal FLAG tag. All data collection and refinement statistics are summarized in Table 4. Protein figures were generated using PyMOL (Schrodinger, LLC. The PyMOL Molecular Graphics System, Version 1.3r1. (2010)).

TABLE 4

| X-ray crystal structure of LbNOX | |
|---|---|
| | LbNOX |
| Resolution range | 92.37-2.41 |
| Space group | P1 |
| Unit cell | 67.968 86.350 93.327 96.92 94.07 92.40 |
| Total reflections | |
| Unique reflections | 75784 |
| Multiplicity | |
| Completeness (%) | 97.98 |
| I/sigma(I) | |
| Wilson B-factor | |
| R-sym | |
| R-factor | 0.18 |
| R-free | 0.22 |
| Number of atoms | 146490 |

TABLE 4-continued

X-ray crystal structure of LbNOX

|  | LbNOX |
| --- | --- |
| Protein residues |  |
| Water molecules |  |
| RMS(bonds) | 0.017 |
| RMS(angles) | 1.978 |
| Ramachandran favored (%) |  |
| Ramachandran outliers (%) |  |

The X-ray crystallography data described above were subsequently refined through further analysis. These data are presented in Table 5 below.

TABLE 5

X-ray Data Collection and Structure Refinement Statistics*

| Protein | NADH oxidase |
| --- | --- |
| Organism | *Lactobacillus brevis* |
| PDB ID | 5ER0 |
| Data collection |  |
|  |  |
| Space group | P1 |
| Cell dimensions |  |
|  |  |
| a, b, c (Å) | 67.9, 86.3, 93.3 |
| α, β, γ (°) | 96.9, 94.0, 92.4 |
| Resolution (Å) | 48.03-2.40, (2.49-2.40)** |
| No. reflections | 79832 (7488) |
| $R_{sym}$ (%) | 11.2 (43.0) |
| $R_{means}$ (%) | 13.0 (50.5) |
| $<I/\sigma(I)>$ | 9.5 (2.1) |
| Wilson B-factor | 25.2 |
| Completeness (%) | 98.0 (91.8) |
| Multiplicity | 3.9 (3.5) |
| Refinement |  |
|  |  |
| R-work | 0.1620 (0.2302) |
| R-free | 0.2008 (0.2652) |
| Number of non-hydrogen atoms | 14999 |
| protein | 13755 |
| ligands | 260 |
| water | 984 |
| Protein residues | 1804 |
| Number of monomers in ASU | 4 |
| RMS(bonds) (Å) | 0.008 |
| RMS(angles) (°) | 1.140 |
| Ramachandran favored (%) | 97 |
| Clashscore | 2.92 |
| Average B-factor | 29.4 |
| protein | 29.5 |
| ligands | 22.9 |
| solvent | 30.9 |
| Rotamer outliers (%) | 0.8 |

*Data were collected from a single crystal.
**Values in parentheses represent the highest-resolution shell.

Cell Proliferation Assays

A. Rescue of Chloramphenicol and Ethidium Bromide-Induced Inhibition of Cell Proliferation:

Five hundred HeLa Tet3G NDI1, Luciferase, LbNOX or mitoLbNOX cells were seeded in 200 µl of DMEM (DMEM (US Biological, D9800), 3.7 g/L NaHCO$_3$, 10% dialyzed FBS (Life Technologies, 26400-044)) per well in a black 96-well plate with clear bottom (Corning, 3904). Twenty four hours after seeding, media was exchanged to DMEM without pyruvate (DMEM (US Biological, D9802), 15.9 mg/L phenol red, 3.7 g/L NaHCO$_3$, 10% dialyzed FBS (Life Technologies, 26400-044))±10 µg/ml chloramphenicol±30 ng/ml ethidium bromide±1 mM pyruvate±300 ng/ml doxycycline. After 0, 2, 3, 4, 5 and 6 days, media was aspirated and cells were fixed by adding 100 µl of 4% paraformaldehyde in PBS and incubating at room temperature for at least 30 min. Paraformaldehyde solution was aspirated and cells were stained with 200 µl of 1 µg/ml Hoechst 33345 in PBS. Plates were covered with sealing aluminum foil and stored at 4° C. before counting cells in each well with Molecular Dynamics IMAGEXPRESS® Ultra (see "Nuclei counting using Molecular Devices IMAGEXPRESS® Ultra," below).

B. Rescue of Piericidine and Antimycin-Induced Inhibition of Cell Proliferation:

One thousand HeLa Tet3G NDI1, Luciferase, LbNOX or mitoLbNOX cells were seeded in 200 µl of DMEM (DMEM (US Biological, D9800), 3.7 g/L NaHCO$_3$, 10% dialyzed FBS (Life Technologies, 26400-044)) per well in a black 96-well plate with clear bottom (Corning, 3904). Twenty four hours after seeding, 10 µl of 6 µg/ml doxycycline (300 ng/ml final concentration) or water was added to each well. Twenty four hours after addition of doxycycline, media was exchanged to DMEM without pyruvate (DMEM (US Biological, D9802), 15.9 mg/L phenol red, 3.7 g/L NaHCO$_3$, 10% dialyzed FBS (Life Technologies, 26400-044)), ±1 µM piericidin, ±1 µM antimycin, ±1 mM pyruvate and ±300 ng/ml doxycycline. After 0, 1, 2, 3 and 4 days, media was aspirated and cells were fixed by adding 100 µl of 4% paraformaldehyde in PBS and incubating at room temperature for at least 30 min. Paraformaldehyde solution was aspirated and cells were stained with 200 µl of 1 µg/ml Hoechst 33345. Plates were covered with sealing aluminum foil and stored at 4° C. before counting cells in each well with Molecular Dynamics IMAGEXPRESS® Ultra (see "Nuclei counting using Molecular Devices IMAGEXPRESS® Ultra," below).

C. Rescue of Pierecidin-Induced Inhibition of Cell Proliferation with Pyruvate, Lactate, Malate, Oxaloacetate, Nicotinamide Mononucleotide (PMN) and PJ34:

Two thousand HeLa Tet3G Luciferase cells were seeded in 200 µl of DMEM (DMEM (US Biological, D9800), 3.7 g/L NaHCO$_3$, 10% dialyzed FBS (Life Technologies, 26400-044)) per well in a black 96-well plate with clear bottom (Corning, 3904). Twenty four hours after seeding, media was exchanged to DMEM without pyruvate (DMEM (US Biological, D9802), 15.9 mg/L phenol red, 3.7 g/L NaHCO$_3$, 10% dialyzed FBS (Life Technologies, 26400-044))±1 µM piericidin, ±indicated concentrations of pyruvate, lactate, malate, oxaloacetate, nicotinamide mononucleotide (PMN) or PJ34. After 3 days, media was aspirated and cells were fixed by adding 100 µl of 4% paraformaldehyde in PBS and incubating at room temperature for at least 30 min. Paraformaldehyde solution was aspirated and cells were stained with 200 µl of 1 µg/ml Hoechst 33345. Plates were covered with sealing aluminum foil and stored at 4° C. before counting cells in each well with Molecular Dynamics IMAGEXPRESS® Ultra (see "Nuclei counting using Molecular Devices IMAGEXPRESS® Ultra," below).

Nuclei Counting Using Molecular Devices IMAGEXPRESS® Ultra

Images of 96-well plates with fixed cells stained with Hoechst 33345 were collected using Molecular Devices IMAGEXPRESS® Micro XLS. Four images were taken to cover the whole well. Images were analyzed and nuclei number per well was counted using CellProfiler 2.0 image analysis software (Carpenter, et al., Genome Biol., 7:R100, 2006; and Kamentsky, et al., Bioinformatics, 27:1179, 2011). Cell counting method had a linear range from 500 to 40000 cells per well as determined by counting plates with known number of cells seeded 6 hours prior to fixation.

Glucose Concentration-Dependent Cell Survival

Ten thousand HeLa Tet3G NDI1, Luciferase, LbNOX or mitoLbNOX cells were seeded in 200 µl of DMEM (DMEM (US Biological, D9800), 3.7 g/L NaHCO$_3$, 10% dialyzed FBS (Life Technologies, 26400-044)) per well of a black 96-well plate with clear bottom (Corning, 3904). Twenty four hours after seeding, 10 µl of 6 µg/ml doxycycline (300 ng/ml final concentration) or water was added to each well. Twenty four hours after addition of doxycycline, media was exchanged to DMEM (DMEM (US Biological, D9800), 3.7 g/L NaHCO$_3$, 10% dialyzed FBS (Life Technologies, 26400-044))±300 ng/ml doxycycline. After 24 hours, media was exchanged to DMEM without glucose (DMEM (US Biological, D9800-02), 4 mM glutamine, 3.7 g/L NaHCO$_3$, 10% dialyzed FBS (Life Technologies, 26400-044))±1 µM piericidin, ±300 ng/ml doxycycline, ±indicated glucose concentration. After 24 hours, media was aspirated and cells were fixed by adding 100 µl of 4% paraformaldehyde in PBS and incubating at room temperature for at least 30 min. Paraformaldehyde solution was aspirated and cells were stained with 200 µl of 1 µg/ml Hoechst 33345. Plates were covered with sealing aluminum foil and stored at 4° C. before counting cells in each well with Molecular Dynamics IMAGEXPRESS® Ultra (see "Nuclei counting using Molecular Devices IMAGEXPRESS® Ultra," above).

Analysis of PDH Phosphorylation

Two hundred thousand HeLa Tet3G Luciferase, LbNOX or mitoLbNOX cells were seeded in 2 ml of DMEM (DMEM (US Biological, D9800), 3.7 g/L NaHCO$_3$, 10% dialyzed FBS (Life Technologies, 26400-044)) per well of a 6-well plate. Twenty four hours after seeding, media was exchanged to DMEM without pyruvate (DMEM (US Biological (D9802), 15.9 mg/L phenol red, 3.7 g/L NaHCO$_3$, 10% dialyzed FBS (Life Technologies, 26400-044))±300 ng/ml doxycycline. Twenty four hours after doxycycline addition, media was exchanged to DMEM without pyruvate (DMEM (US Biological, D9802), 15.9 mg/L phenol red, 3.7 g/L NaHCO$_3$, 10% dialyzed FBS (Life Technologies, 26400-044))±300 ng/ml doxycycline±1 µM piericidin±5 mM dichloroacetate (DCA). One hour later, cells were rinsed with 2 ml of ice cold PBS and lysed in the well by adding 400 µl of ice cold 1× Laemmli Sample Buffer with 1× protease/phosphatase inhibitor cocktail (Cell Signaling, 5872S), incubated for 5 min on ice, transferred to an eppendorf tube and heated for 5 min at 95° C. Protein levels were detected using western blot with anti-FLAG antibody (Cell Signaling, 2368) for LbNOX and mitoLbNOX detection, anti-PDH-E1a antibody (Cell Signaling, 2784) and anti-PDH-E1a phosphor-Ser$^{300}$ antibody (EMD Millipore, AP1064).

Metabolite Extraction and Media Preparation for Determination of Lactate, Pyruvate, NAD$^+$ and NADH One million HeLa Tet3G Luciferase, LbNOX or mitoLbNOX cells were seeded per a 10 cm plate in 10 ml of DMEM (DMEM (US Biological, D9800), 3.7 g/L NaHCO$_3$, 10% dialyzed FBS (Life Technologies, 26400-044)). Twenty four hours and 1 hour before extraction, media was exchanged to 10 ml of DMEM without pyruvate (DMEM (US Biological, D9802), 15.9 mg/L phenol red, 3.7 g/L NaHCO$_3$, 10% dialyzed FBS (Life Technologies, 26400-044)) with or without 300 ng/ml doxycycline. The media that was used 1 hour before extraction was preincubated overnight in tissue culture incubator without cells. Media was quickly aspirated, cells rinsed with 15 ml of ice-cold PBS, transferred to dry ice and 4 ml of dry ice cold solution of 80% methanol: 20% water (spiked with 5 µM Sodium L-Lactate-3,3,3-D3 and 0.2 µM Sodium [3-$^{13}$C]Pyruvate) was added and quickly spread around by tilting the plate. The whole procedure from aspiration of media to adding 80% methanol solution took about ~15 seconds. The plate was transferred on dry ice to −80° C. freezer and incubated for 15 min. Cells were collected with cell scraper while the plate was kept on dry ice and the solution was centrifuged at 2,000×g at 4° C. for 5 min. Supernatant was collected and stored on dry ice. The pellet was resuspended in 0.5 ml of 80% Methanol: 20% Water (spiked with 5 µM Sodium L-Lactate-3,3,3-D3 and 0.2 µM Sodium [3-$^{13}$C]Pyruvate) at 4° C., vortexed for 10 sec, incubated for 15 min on wet ice and spun at 2000×g for 5 min. The pellet was reextracted one more time and all the supernatants were combined and stored at −80° C. overnight. Supernatants were evaporated using Speedvac (without heating) down to 1 ml, deproteinated by centrifuging through 10 kDa cutoff filter membrane and further evaporated down to 200 µl using Speedvac. Water was used to bring all the samples up to the same volume of 200 µl. Before analysis, the solutions were centrifuged at 20,000×g for 10 min to get rid of insoluble particles. These water solutions were used for determination of total NAD$^+$/NADH using HPLC accompanied with a UV-vis detector. Samples were diluted with methanol to 80% methanol 20% water solution for LC-MS detection of lactate and pyruvate. Culture media samples were prepared for LC-MS detection of lactate and pyruvate by diluting culture media with methanol to 80% methanol 20% water solution (spiked with 50 µM Sodium L-Lactate-3,3,3-D3 and 2 µM Sodium [3-$^{13}$C]Pyruvate), the 80% methanol solution was incubated at room temperature for 30 min and centrifuged at 20,000×g to pellet the protein precipitate. Supernatant was used for LC-MS analysis.

Determination of Total NAD$^+$/NADH Ratio by HPLC

Metabolites were analyzed by ion exchange chromatography using µBondapak NH$_2$ 300×3.9-mm column (Waters, WAT084040) attached to Agilent 1260 HPLC system. Column was maintained at 24° C. during runs. Typically 80-100 µl of the sample was injected, while the rest of the samples were kept at 4° C. in the autosampler module. Initial conditions were 96% of Buffer A (10 mM KH$_2$PO$_4$, pH 4.4) and 4% Buffer B (1000 mM KH$_2$PO$_4$, pH 4.5) and a flow rate of 1.0 ml/min. Between 10 and 40 min, Buffer B was increased to 45%. Between 40 and 41 min Buffer B was increased to 100% and kept at that concentration for 5 min. Between 46 and 47 min, Buffer B was decreased to 4% and held for 20 min at that composition to equilibrate the column between injections. Absorbance was monitored at 255 µM for NAD$^+$ and 255 µM and 340 µM for NADH. Under these conditions, the retention time for NAD$^+$ was 5.8 min and for NADH was 12.7 min. Calibration curves were generated using known amounts of NAD$^+$ (0.3-2.4 pMoles) and NADH (0.05-0.3 pMoles). In this method we were also able to detect other nucleotides with the following retention times: AMP 6.7 min, ADP 18.6 min and ATP 27.5 min. Energy charge calculated ([ATP]+0.5 [ADP])/([ATP]+[ADP]+[AMP]) was usually ~0.95.

LC-MS Method for Detection of Lactate and Pyruvate

An Agilent 1260 HPLC system coupled to Q Exactive Mass Spectrometer (ThermoFisher) was used to perform measurements of lactate and pyruvate in both the cell extract and cell media samples. A ZIC-cHILIC column 150×2.1 mm (3 µm particle size) (Merck) was used and kept at room temperature. Initial conditions were 15% of Buffer A (20 mM CH$_3$COONH$_4$—NaOH, pH 7.7) and 85% Buffer B (acetonitrile) and a flow rate of 0.22 ml/min. Between 0.5 and 3.5 min, Buffer B was decreased to 75%. Between 3.5 and 9 min Buffer B was decreased to 40%. Between 9 and 10.5 min Buffer B was decreased to 2% and kept at that concentration for 1 min. Between 11.5 and 12.5 Buffer B was increased to 85% and held for 12 min at that composition to equilibrate the column between injections. Needle washing solution was 75% acetonitrile. Ten microliters of the sample was injected into LC-MS. Negative mode ionization was applied. Targeted SIM method was used to acquire the MS data. The following MS conditions were used: microscan 1; resolution 140,000; AGC target 5E5; maximum 120 ms; msx 4; isolation window 1.0 m/z. The inclusion list was 87.0088 (pyruvate), 89.0244 (lactate), 90.0188 (sodium [3-$^{13}$C]pyruvate), 92.0429 (sodium L-lactate-3,3,3-D3). The ratio of the peak intensity of lactate or pyruvate to peak intensity of isotope labeled lactate or pyruvate was calculated. The isotope ratio method was used to quantify the lactate and pyruvate in the cell extract and media.

Fluorescence Microscopy

One hundred thousand HeLa Tet3G Luciferase, LbNOX or mitoLbNOX cells were seeded per well of 6-well plate (with a No 1.5 coverslip in each well) in 2 ml of DMEM (DMEM (US Biological, D9800), 3.7 g/L NaHCO$_3$, 10% dialyzed FBS (Life Technologies, 26400-044)). Twenty four hours after seeding, media was exchanged to 2 ml of DMEM (DMEM (US Biological, D9800), 3.7 g/L NaHCO$_3$, 10% dialyzed FBS (Life Technologies, 26400-044)) with 300 ng/ml doxycycline. Twenty four hours after dox addition, coverslip was removed from the well, rinsed in warm PBS (37° C.), fixed in 4% paraformaldehyde in warm PBS (37° C.) for 5 min, rinsed in PBS and quenched with TBS, 0.1% Triton X-100 for 10 min. Coverslips were blocked with PBS, 2% BSA, 0.1% Triton X-100 for 10 min, stained with mouse anti-Tomm20 (Santa Cruz, sc-17764) in PBS, 2% BSA, 0.1% Triton X-100 for 1 hour, washed 3 times for 5 min with PBS, then stained with both ALEXA FLUOR® 488-conjugated anti-FLAG (Cell Signaling, 3916) and ALEXA FLUOR® 645-conjugated anti-mouse IgG secondary antibody (Cell Signaling, 4408) in PBS, 2% BSA, 0.1% Triton X-100 for 1 hour and washed 3 times for 5 min with PBS. Coverslip were mounted on slides using PROLONG GOLD® (Life Technologies, P10144). Fluorescent images were acquired using Leica SPS AOBS Scanning Laser Confocal Microscope (HCX PL APO CS 40×1.25NA Oil UV objective, Argon 488 pM laser for ALEXA FLUOR® 488 and HeNe 633 µM laser for ALEXA FLUOR® 645).

Gluconeogenesis in Primary Hepatocytes

Primary hepatocytes were obtained from the MGH Cell Resource Core, where they were freshly isolated by collagenase perfusion of livers from 24-hour fasted Sprague-Dawley rats and plated onto 24-well collagen-coated plates. Twenty four thousand cells were plated and cultured overnight in isolation media (DMEM with high glucose and pyruvate (Life Technologies, 11995)) supplemented with 20 ng/mL epidermal growth factor, 14.3 µg/mL glucagon, insulin, 7.5 µg/mL hydrocortisone, 10% FBS, 1% Penicillin-streptomycin). Cells were then transduced with the indicated adenoviral vector (MOI 20) and were serum starved by incubating in DMEM without additional supplementation overnight. Twenty-four hours after transduction the cells were washed twice with PBS and placed in glucose-free DMEM for 2 hours to deplete any residual glycogen stores. This media was removed and replaced with fresh glucose-free, glutamine-free and phenol-red free DMEM (Life Technologies, A14430) supplemented with lactate to a final concentration of 5 mM. Media was sampled 6 hours later and glucose was measured using the AMPLEX® Red Glucose Assay (Life-Technologies) and normalized to total protein levels from hepatocytes lysed in 1% SDS as measured by the BCA assay. Separate glucose standardization curves for the Amplex Red assay were created in the presence of gluconeogenic substrate used.

Example 2. Structural and Functional Properties of LbNOX and mitoLbNOX

Figure 8:
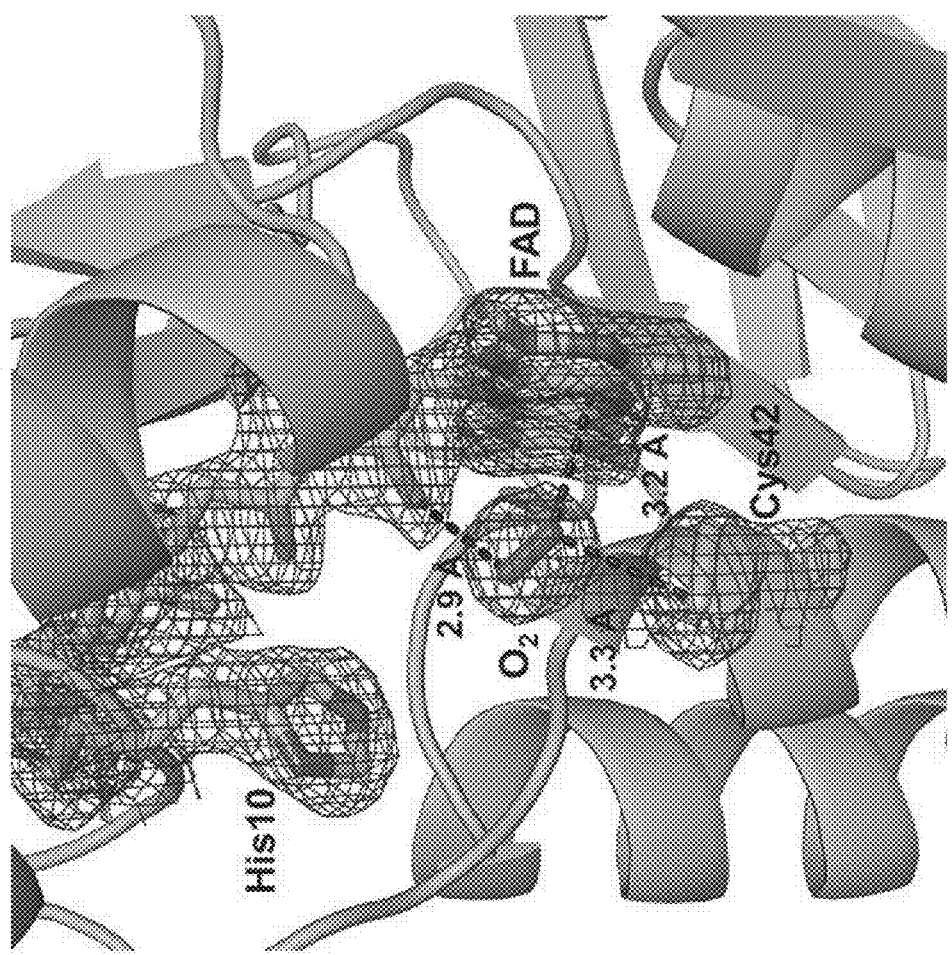
FIG. 8 shows $O_2$ in the active site of LbNOX as determined by X-ray crystallography. $2F_o$-$F_c$ electron density around FAD, His50, Cys82, and oxygen contoured at 1.5 σ. His50, Cys82, FAD, and oxygen are depicted in sticks representation. Dashed lines depict hydrogen bonds.

The proposed mechanism by which LbNOX catalyzes the oxidation of NADH to NAD$^+$, as well as the residues that establish critical contacts with cofactors, are manifested in the intermolecular contacts revealed by the crystal structure of LbNOX. A 2.4 Å resolution X-ray structure of a fusion protein consisting of LbNOX and a FLAG epitope tag was solved in order to probe the structural features of LbNOX that relate to its enzymatic activity. The details of this structure are reported in Table 4. Two molecules of LbNOX-FLAG related by non-crystallographic two-fold symmetry form a tightly associated dimer (2682 Å$^2$ of buried surface area (BSA)) in which the C-terminal dimerization domain of each monomer penetrates deep into its pair mate active site comprised of the FAD and the redox active Cys82 (FIG. 1E). The main chain carbonyl oxygen of Phe422 in each monomer is hydrogen bonded to N3 of FAD, an interaction likely to contribute to the catalytic function of LbNOX. Molecular oxygen (O$_2$) is bound in the active site of each monomer and unlike other related structures the redox active Cys82 of LbNOX is in a reduced form, facing away from the isoalloxazine ring, and well separated from O$_2$ (FIG. 8). Two dimers of LbNOX are linked into a tetramer within the asymmetric unit of the triclinic crystal lattice, consistent with the tetramer found in solution. The interaction between the dimers (2×769 Å$^2$ BSA) is significantly weaker than that within the catalytic dimer. LbNOX selectively oxidizes NADH over NADPH, and this substrate specificity can be explained structurally by the steric effect of Asp177, which would clash with the phosphate moiety of NADPH. This substrate selectivity is also explained by the lack of cationic residues at positions 178,179, and 184, (SEQ ID NO: 1) which are required for stabilization of NADPH binding (FIG. 1E). The high selectivity for NADH over NADPH, negligible H$_2$O$_2$ production relative to H$_2$O, and very low K$_M$ for O$_2$ renders LbNOX an attractive enzyme for therapeutic application in mammalian cells (e.g., human cells).

Figure 2A:
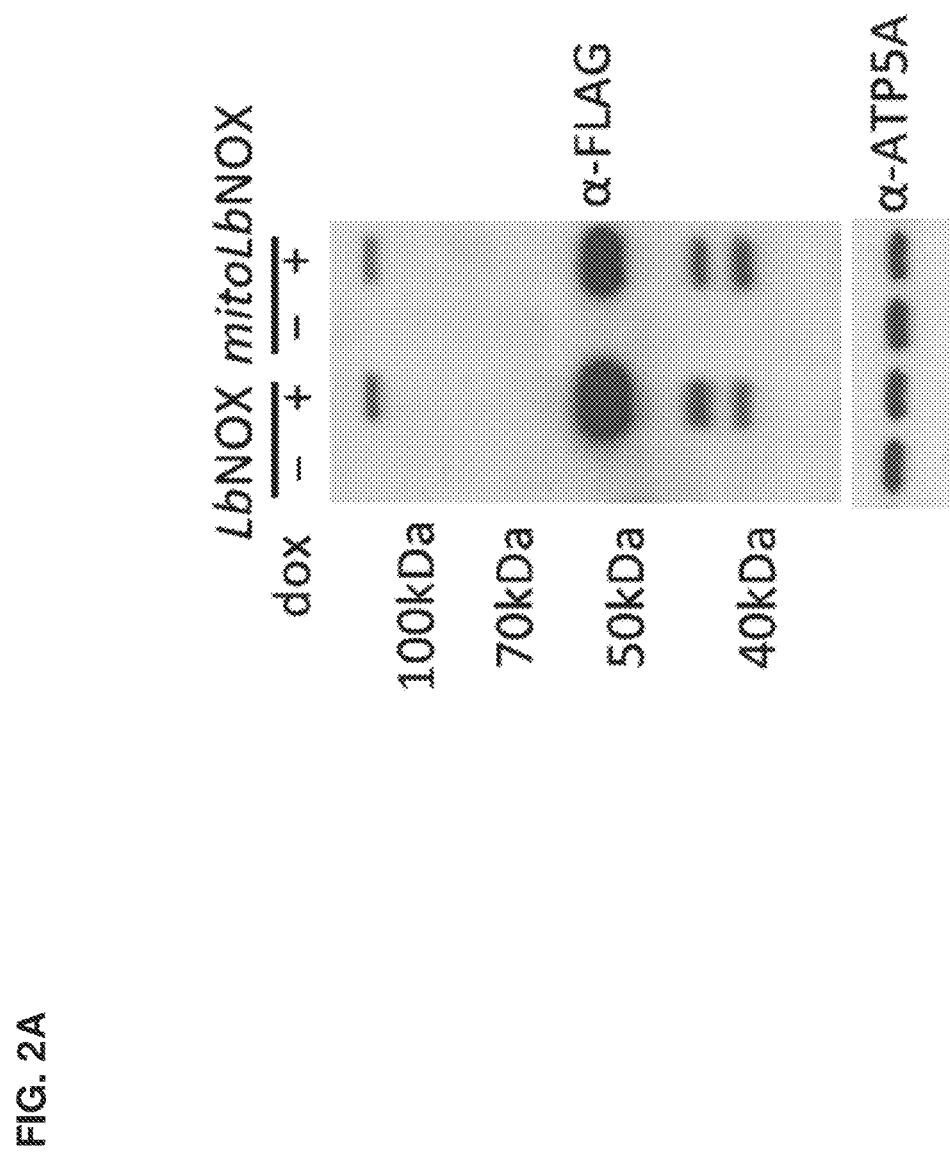
FIGS. 2A-2C illustrate the expression and activity of LbNOX in mammalian cells.
Figure 2B:
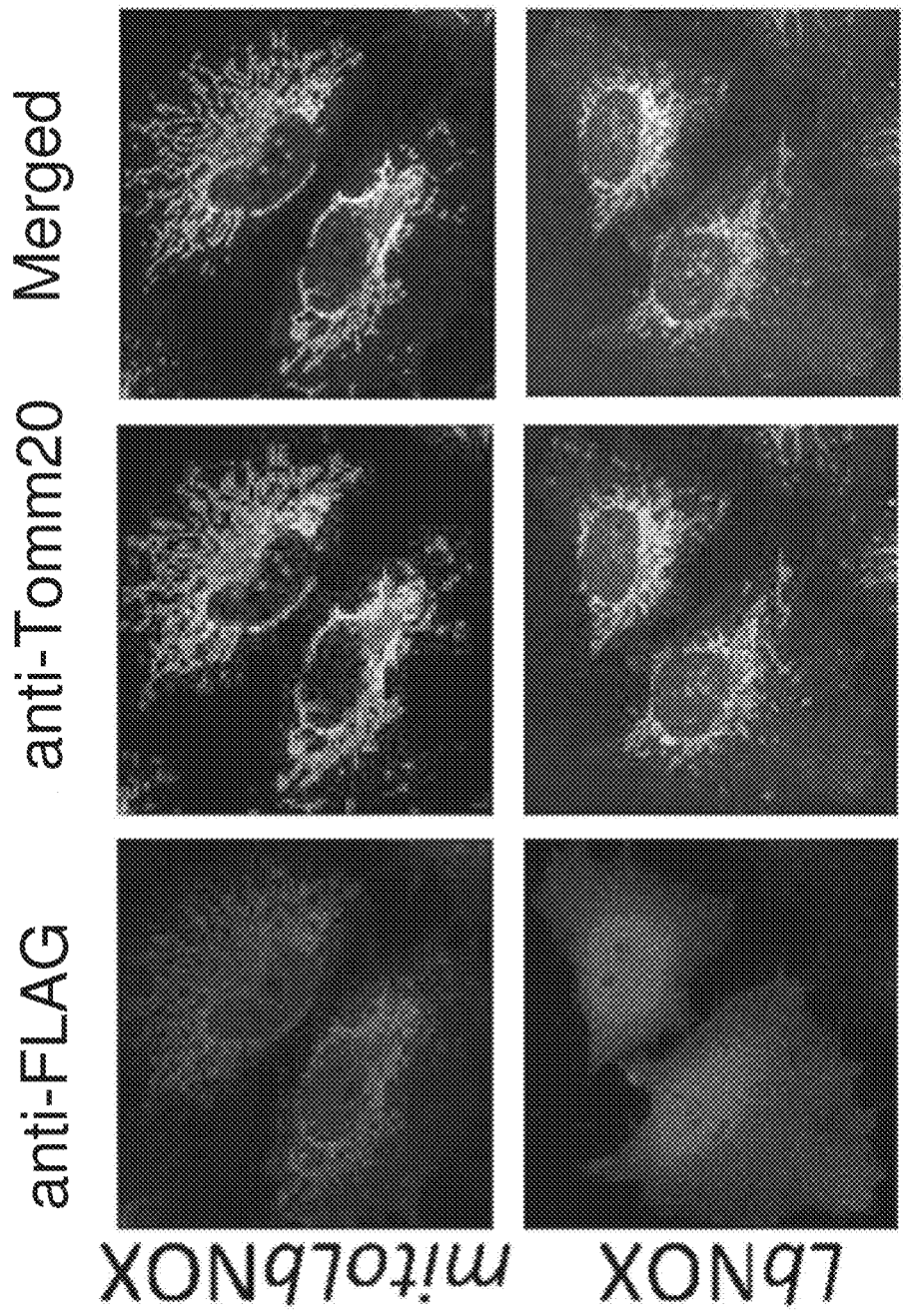
Figure 2C:
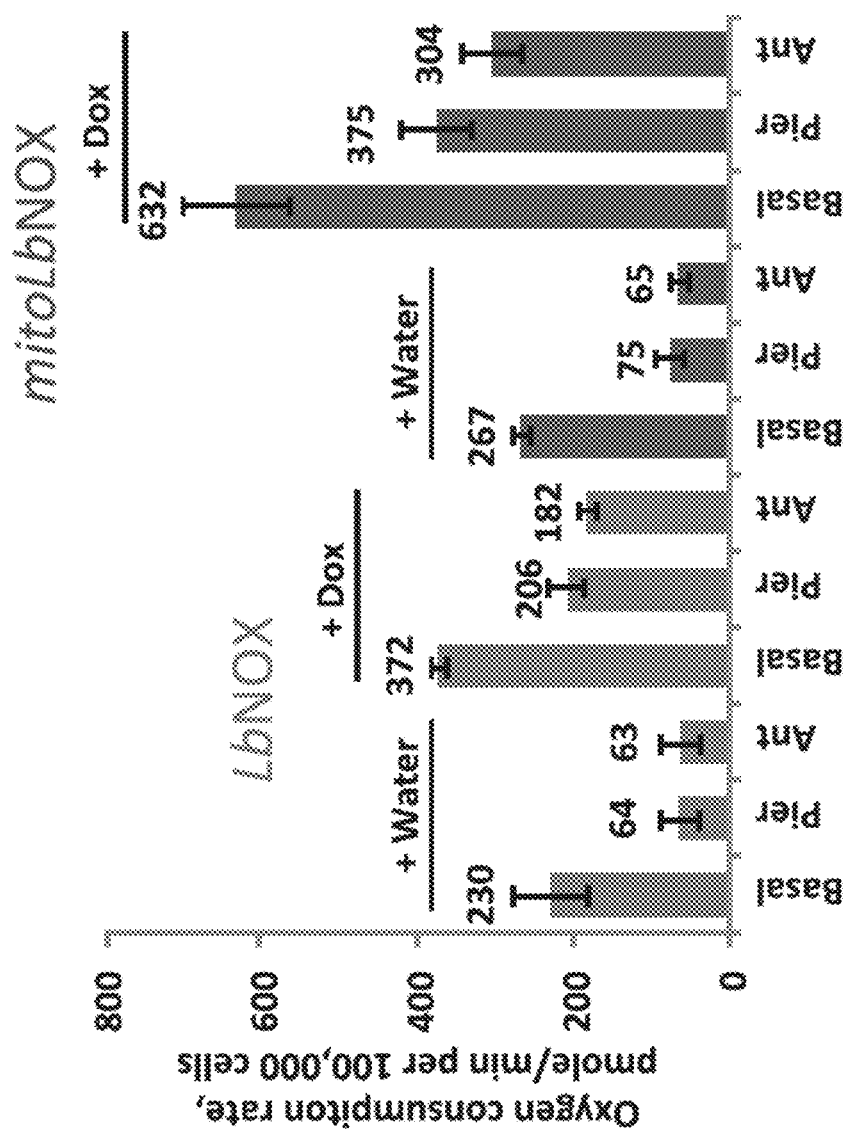
Figure 9A:
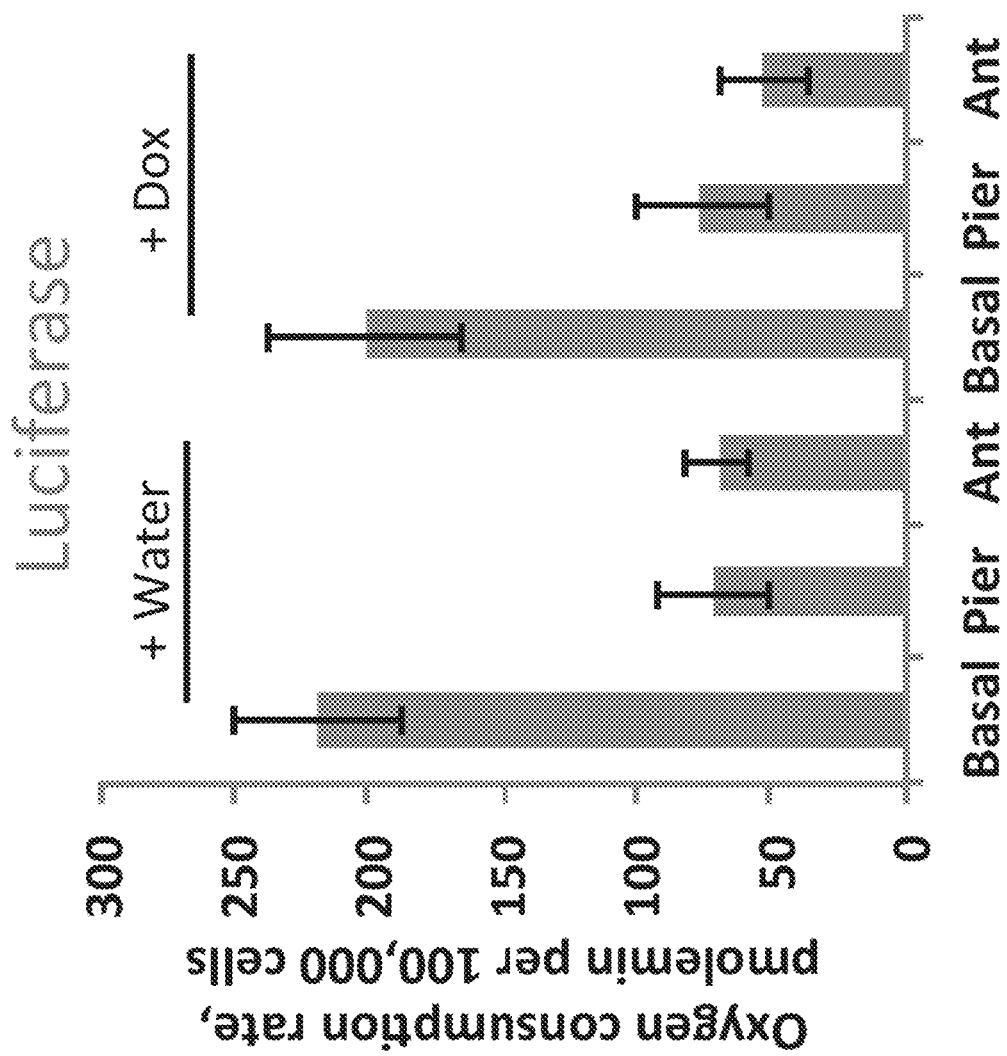
FIGS. 9A-9D show the effect of Luciferase expression and doxycycline addition on basal, piericidin-resistant and antimycin-resistant respiration measured with XF24 extracellular flux analyzer (FIG. 9A), NAD$^+$/NADH ratio (FIG. 9B), secreted lactate/pyruvate ratio and intracellular lactate/pyruvate ratio (FIG. 9C), and PDH phosphorylation (FIG. 9D). Mean values±S.D.

Example 3. Water-Forming NADH Oxidases Increase Oxygen Consumption in Mammalian Cells The water-forming NADH oxidases for use in the compositions and methods of the invention can be expressed in mammalian cells (e.g., human cells) using any of a variety of established methods that are known in the art. These enzymes can additionally be directed to selectively localize to a specific organelle by conjugation of these proteins with organelle-targeting sequences. Expression of both LbNOX and LbNOX conjugated to a polypeptide containing the mitochondrial targeting sequence of subunit IV of human cytochrome c oxidase (hereinafter "mitoLbNOX") in HeLa cells led to a robust increase in oxygen consumption (FIG. 2C). LbNOX and mitoLbNOX increased oxygen consumption of HeLa cells by 1.6 and 2.4-fold, respectively. Increase in oxygen consumption induced by LbNOX expression was resistant to 1 µM piericidin, a known inhibitor of complex I, as well as to 1 µM antimycin, a known inhibitor of complex III, indicating that the increase in oxygen consumption is due to LbNOX oxidase activity and not due to the increased activity of mitochondrial electron transport chain (Srivastava, et al., FEBS J., 274:4788, 2007). Addition of doxycycline had no effect on oxygen consumption of HeLa cells expressing Luciferase under the control of TRE3G promoter (FIG. 9A). Significantly, mitoLbNOX induced a larger increase in oxygen consumption than LbNOX (FIG. 2C), likely due to the higher concentration of NADH within mitochondria (Hung, et al., Cell Metab., 14:545, 2011; Williamson, et al., Biochemic. J., 103:514, 1967; and Zhao, et al., Cell Metab., 14:555, 2011).

Figure 3A:
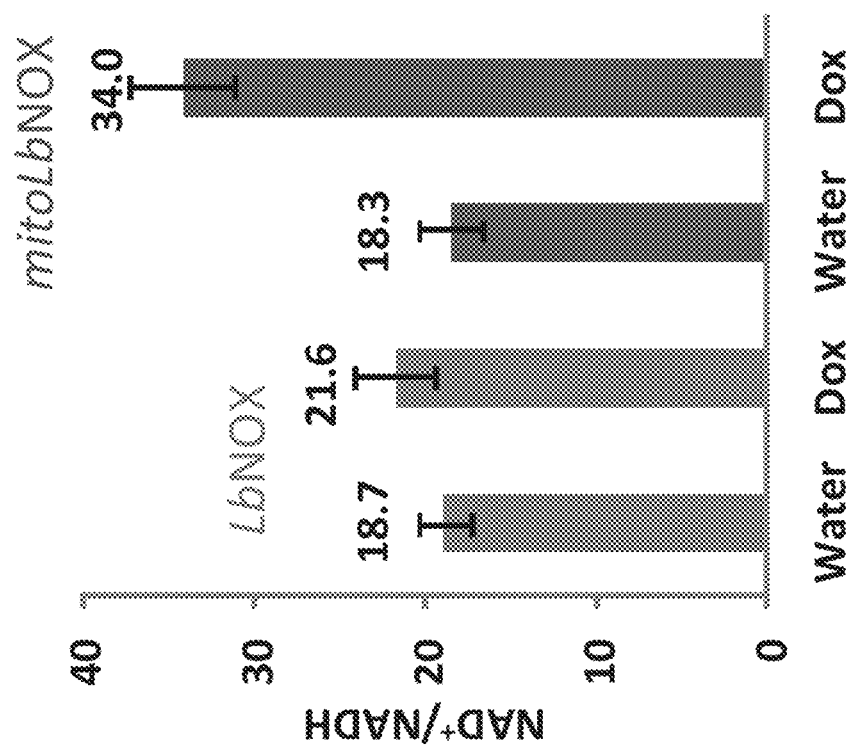
FIGS. 3A-3D show the effect of LbNOX on compartment specific NAD$^+$/NADH ratio, gluconeogenesis and PDH phosphorylation.
Figure 9B:
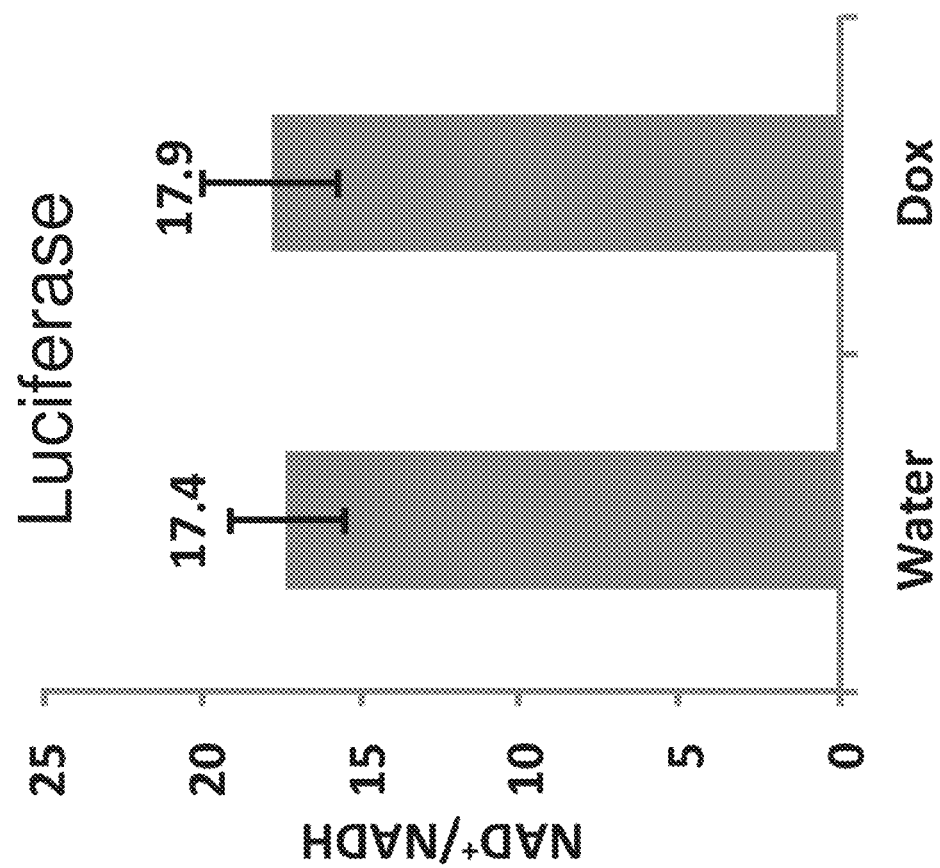

Example 4. Water-Forming NADH Oxidases Increase the Ratio of $NAD^+$ to NADH in Mammalian Cells mitoLbNOX also exhibited the ability to increase the total $NAD^+$/NADH ratio by 2-fold, while LbNOX or Luciferase did not have a significant effect on this ratio since these enzymes were not targeted to the mitochondria (FIG. 3A and FIG. 9B). Perturbation of total $NAD^+$/NADH in this experiment is specifically due to changes in mitochondrial NADH because most of the effect on the ratio was due to changes in NADH concentration and most of the NADH inside the cell comes from mitochondria. The latter is supported by fractionation experiments and by the observation that the majority of NAD(P)H autofluorescence in cells comes from mitochondria.

Figure 3B:
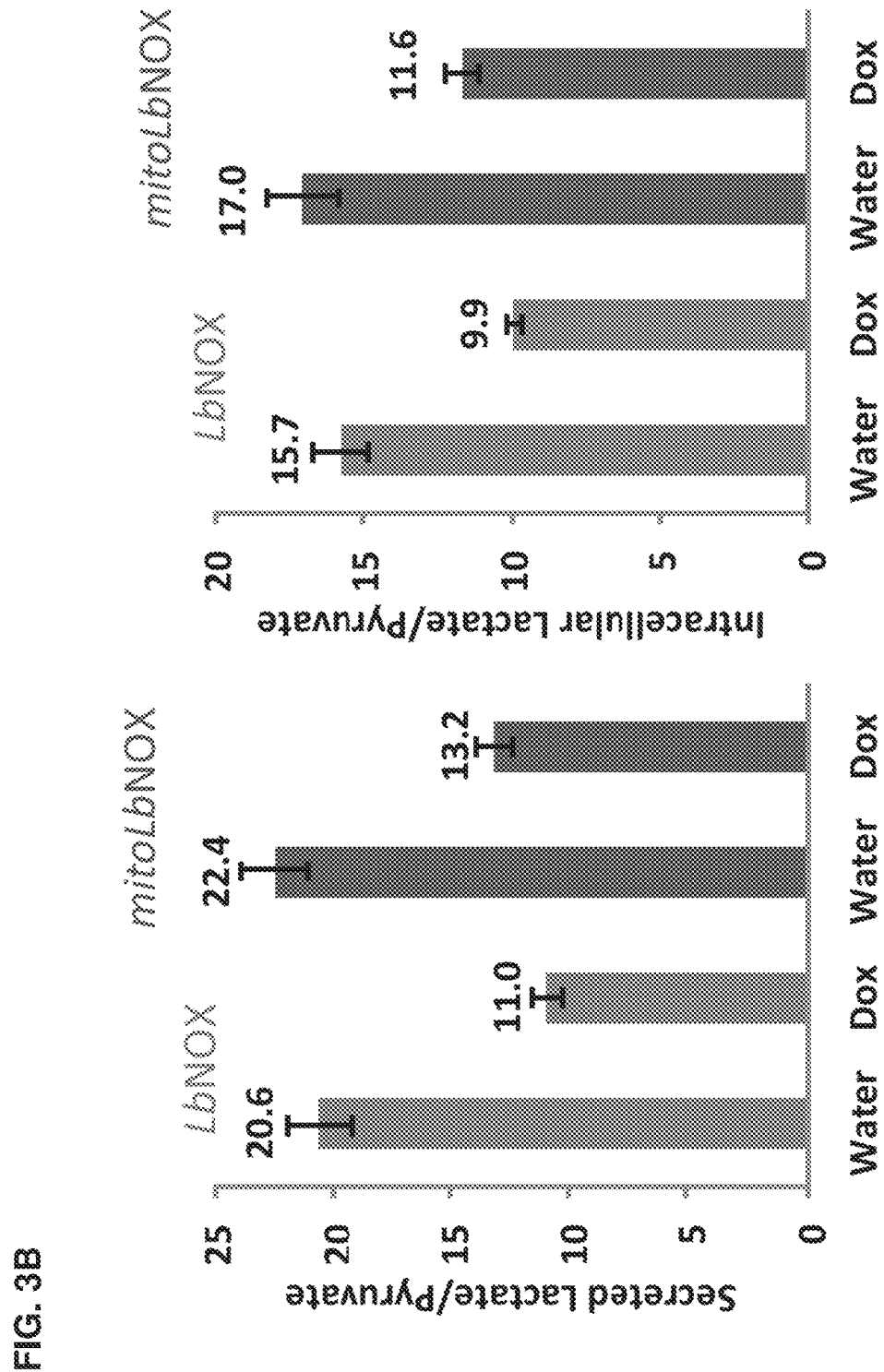
Figure 9C:
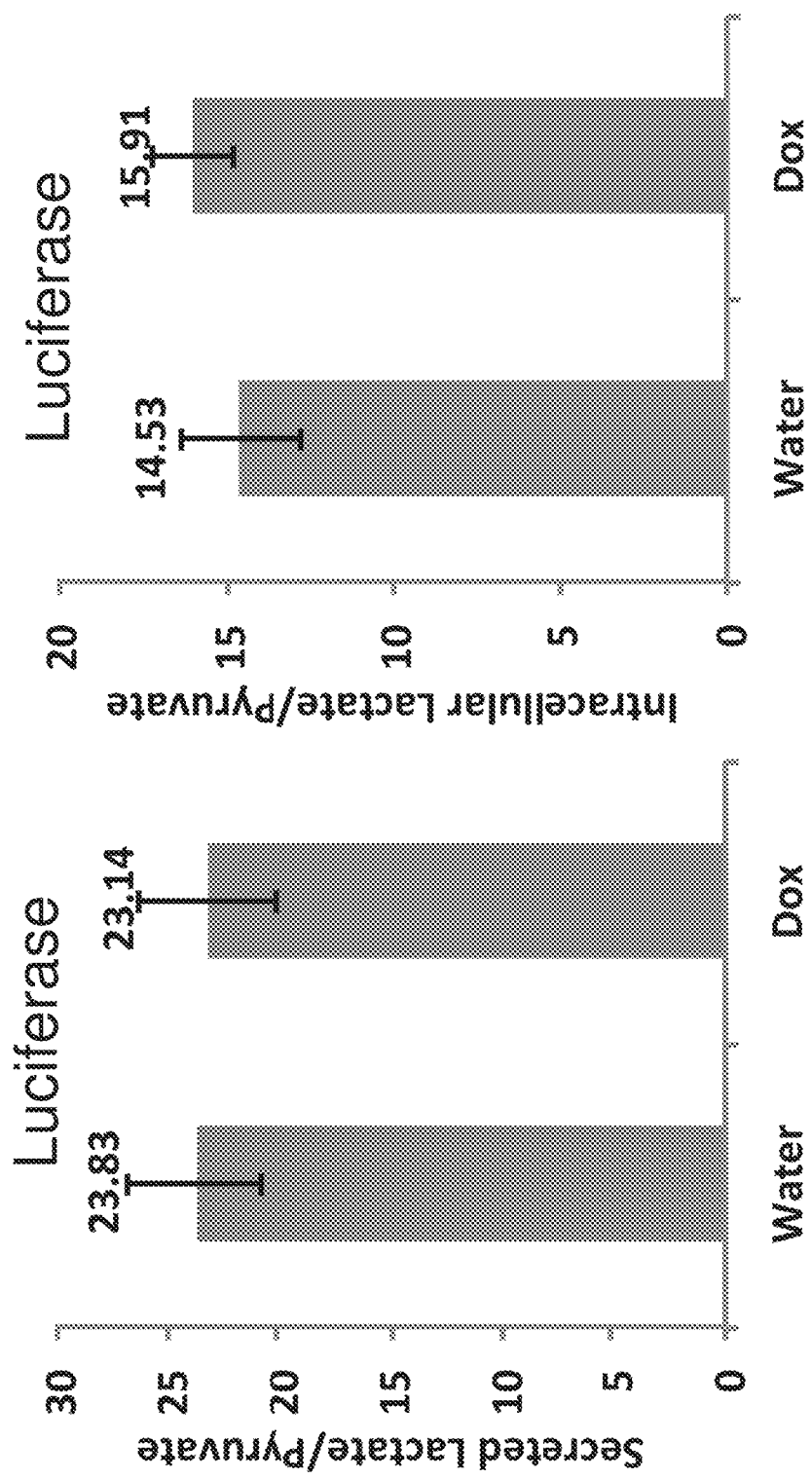

To specifically interrogate the cytoplasmic free $NAD^+$/NADH, the effect of LbNOX and mitoLbNOX on the intracellular and secreted lactate/pyruvate ratio was determined (FIG. 3B). Intracellular and secreted lactate/pyruvate ratio is believed to be in equilibrium with cytoplasmic $NAD^+$/NADH through the reaction catalyzed by lactate dehydrogenase. Both LbNOX and mitoLbNOX decreased intracellular and secreted lactate/pyruvate ratio by 1.5-2-fold (i.e. increased cytoplasmic $NAD^+$/NADH) with LbNOX being slightly more active (FIG. 2C). Luciferase expression had no effect on either of those parameters (FIG. 9C). Thus, LbNOX is more active at perturbing cytoplasmic $NAD^+$/NADH, while mitoLbNOX is more active at perturbing mitochondrial $NAD^+$/NADH. These data show that cytoplasmic and mitochondrial $NAD^+$/NADH ratios can be regulated independently to some extent despite being connected through NADH shuttle systems (e.g. glycerol-3-phosphate and aspartate-malate shuttles) and that this compartmentalization can be modulated using water-forming NADH oxidases. Of particular significance is the use of water-forming NADH oxidases that comprise a fusion protein including a targeting sequence that localizes the oxidase to a particular organelle within the mammalian cell to perturb reductive potential in a compartment-specific manner.

Figure 3C:
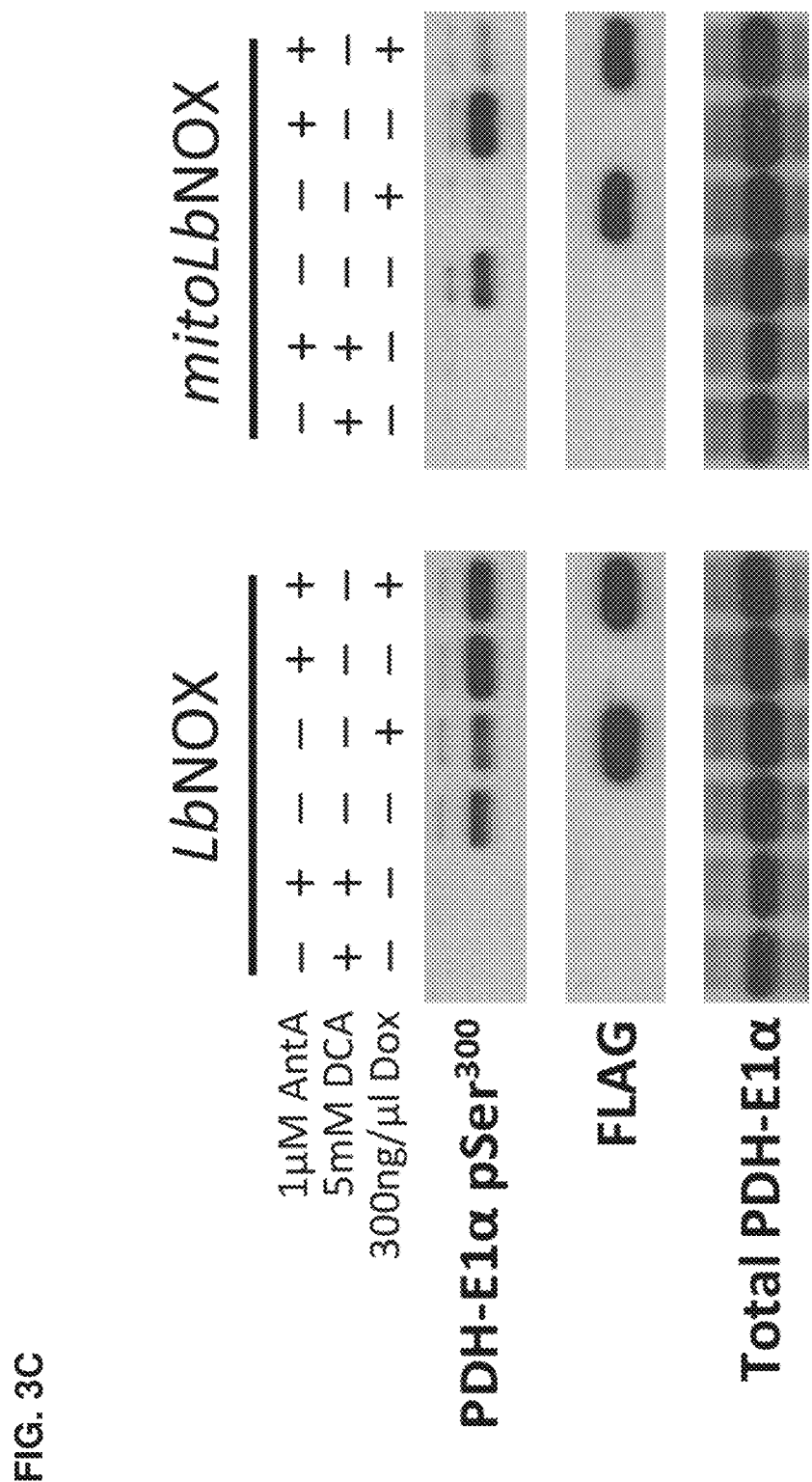
Figure 9D:
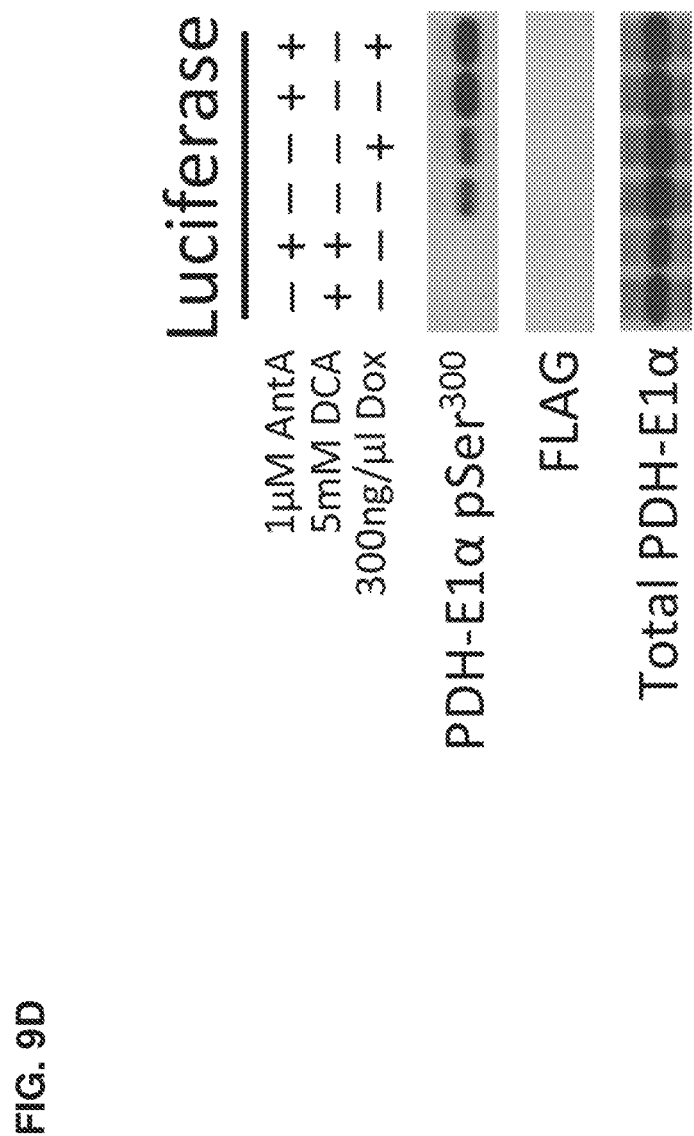
Figure 10A:
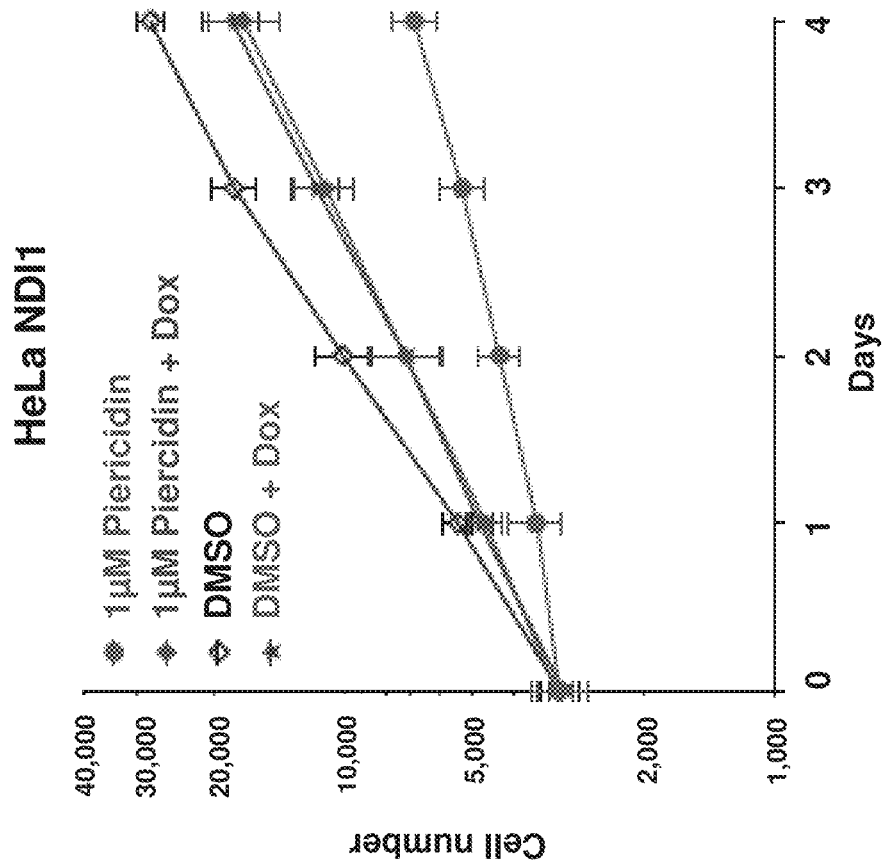
FIGS. 10A-10L show the effect of yeast Ndi1 (FIGS. 10A-10D), Luciferase (FIGS. 10E-10H) and pyruvate (FIGS. 10I-10L) on piericidin (FIGS. 10A, 10E, and 10I), antimycin (FIGS. 10B, 10F, and 10J), chloramphenicol (FIGS. 10C, 10G, and 10K) and ethidium bromide (FIGS. 10D, 10H, and 10L) induced proliferative defect in HeLa cells. Mean values±S.D.
Figure 10B:
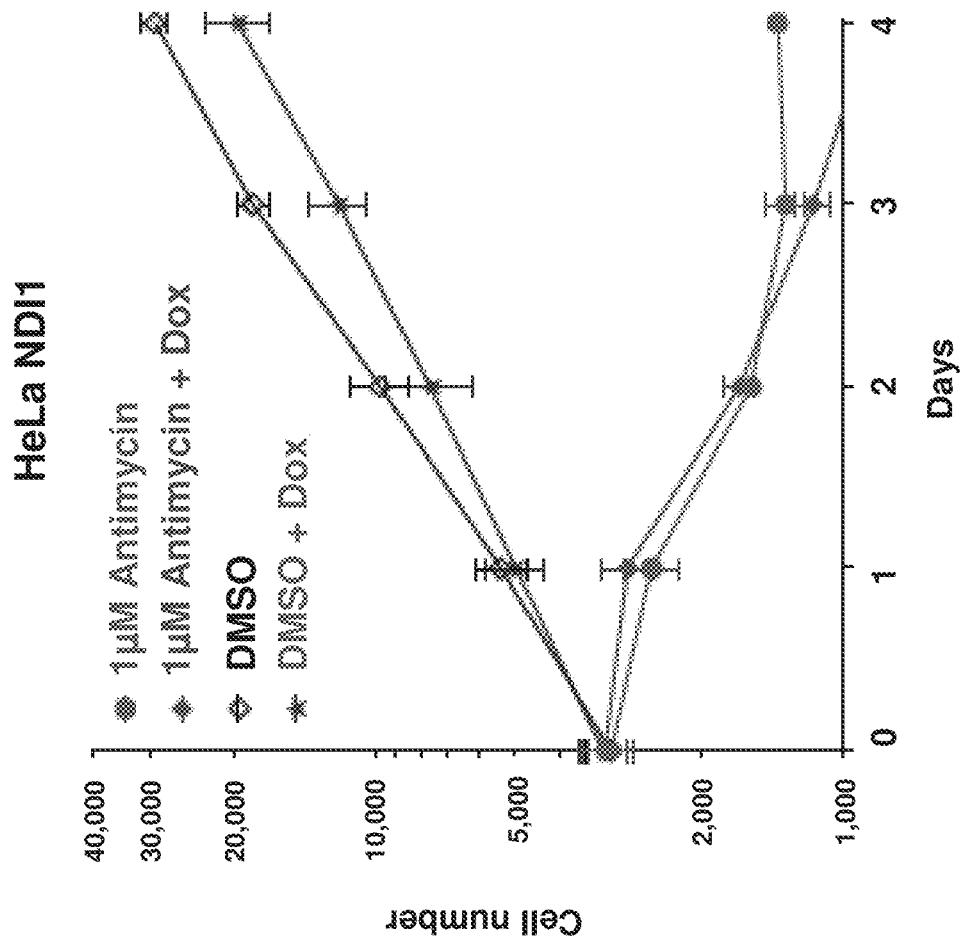
Figure 10C:
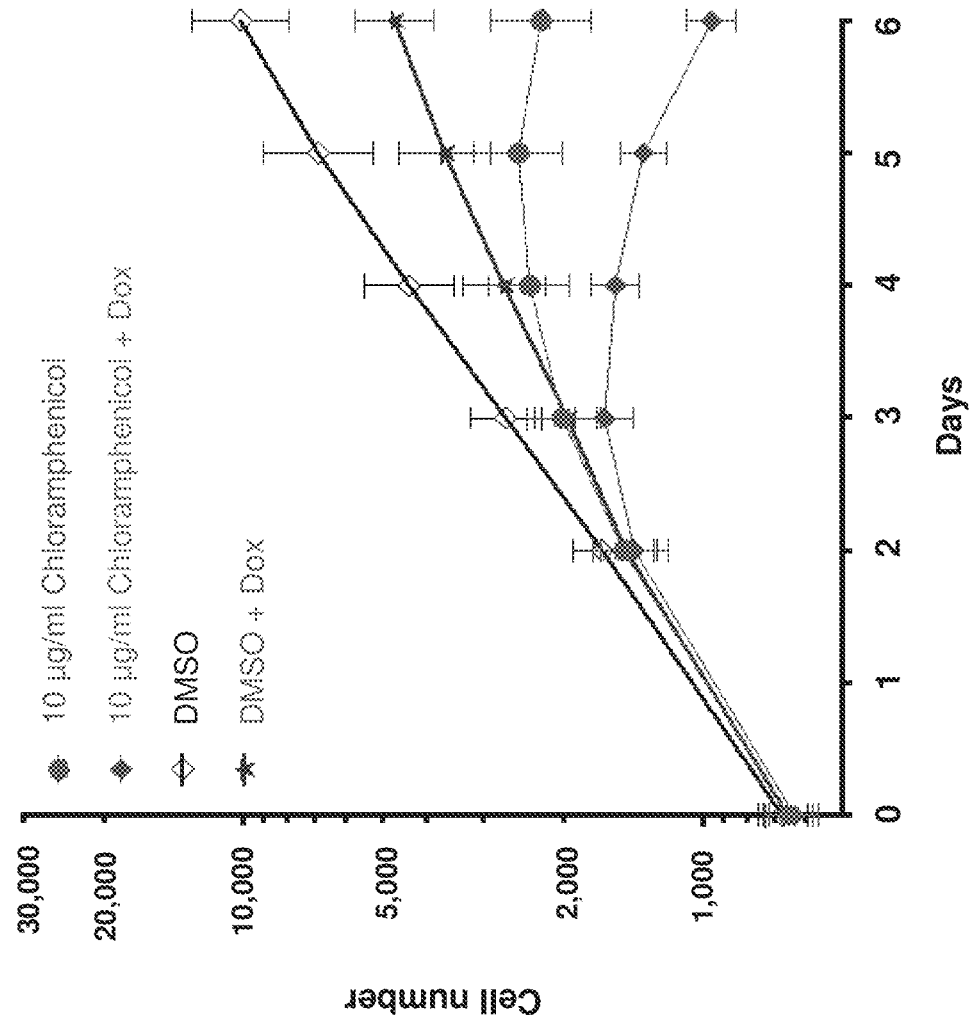
Figure 10D:
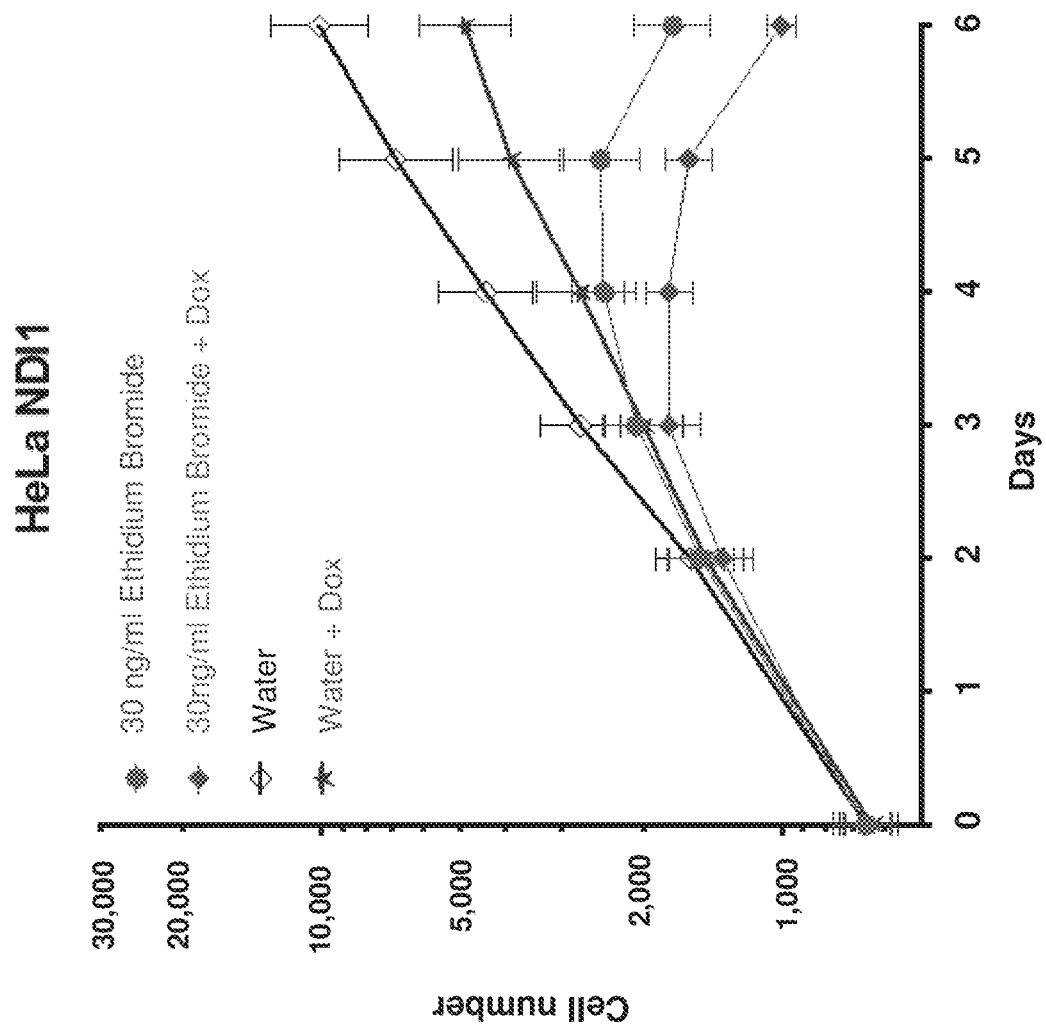
Figure 10E:
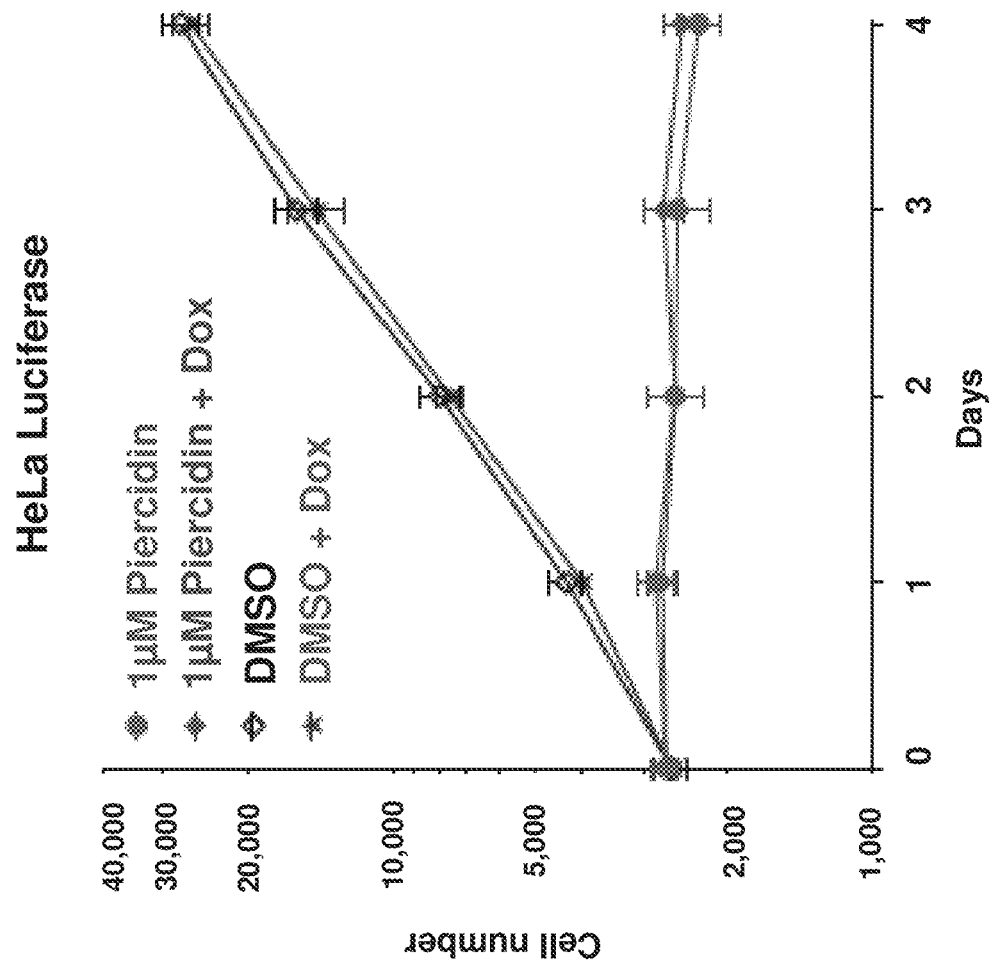
Figure 10F:
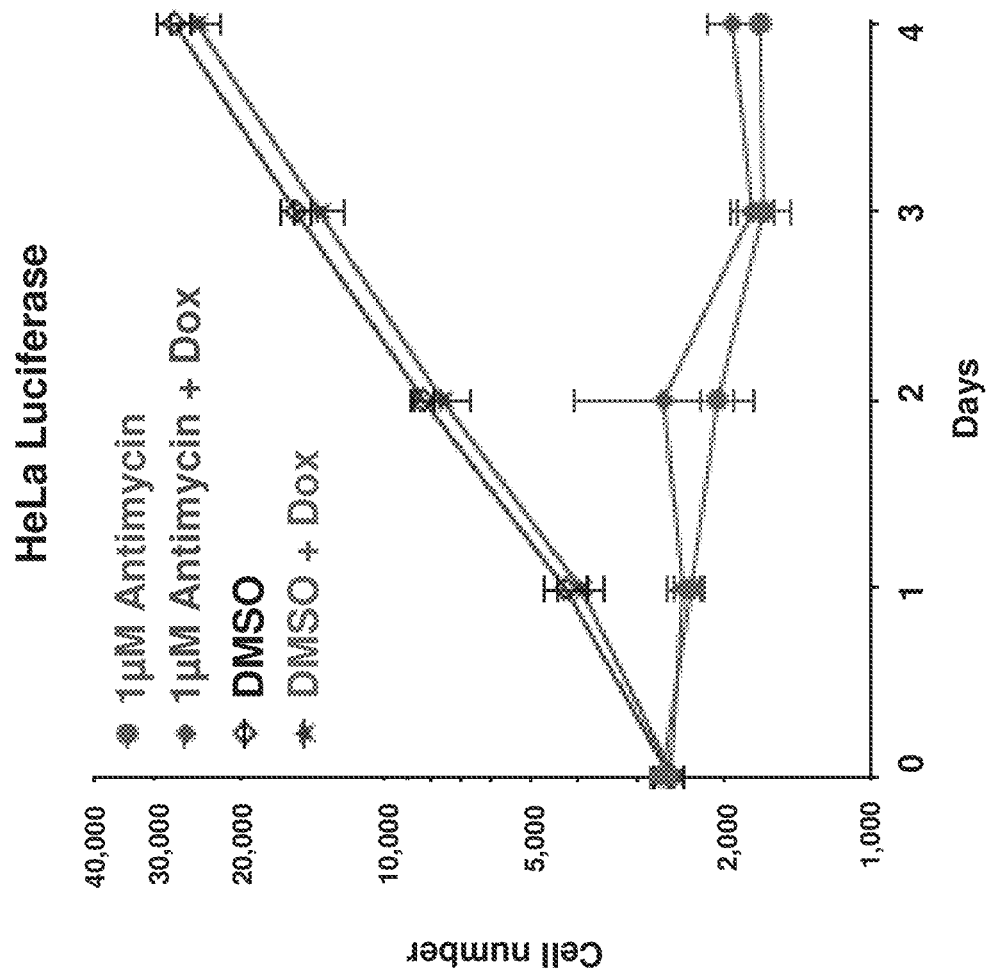
Figure 10G:
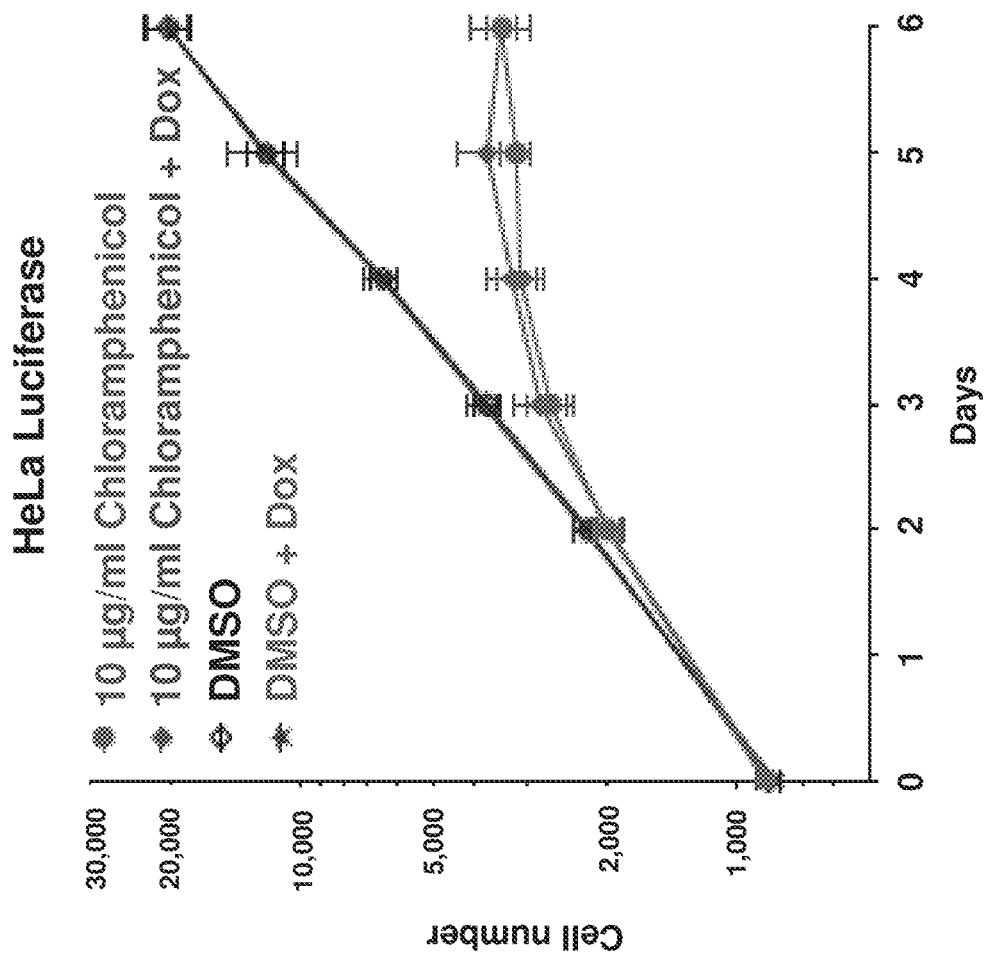
Figure 10H:
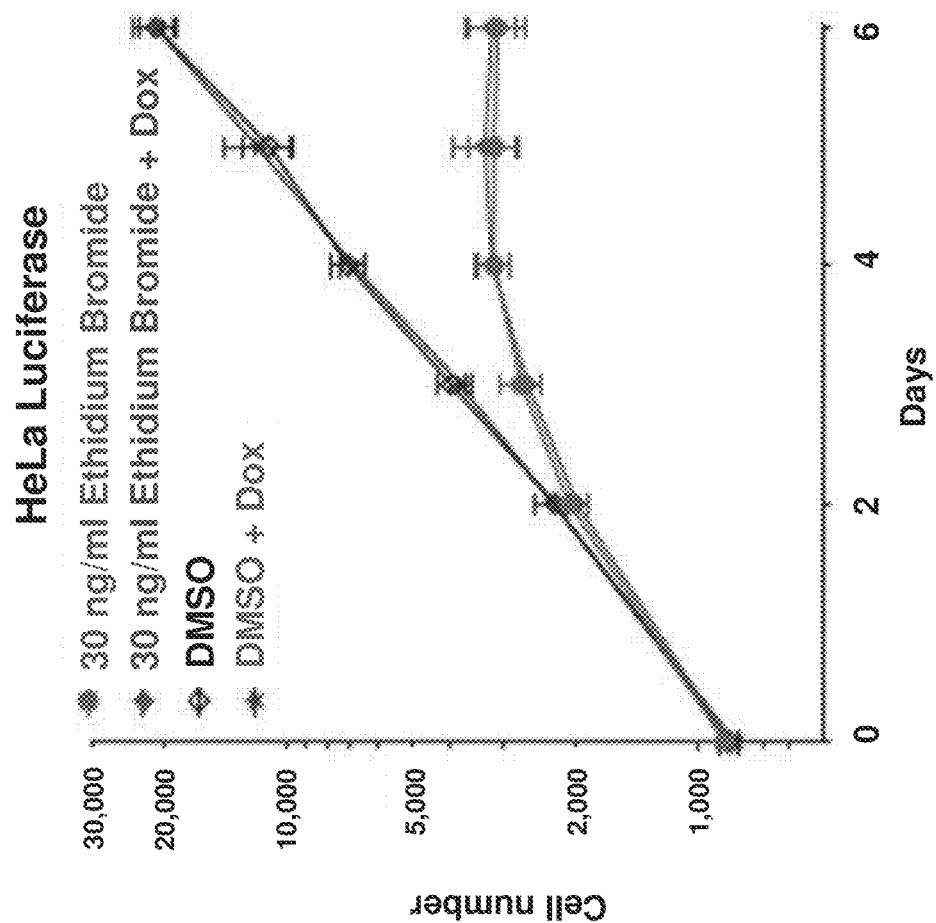
Figure 10I:
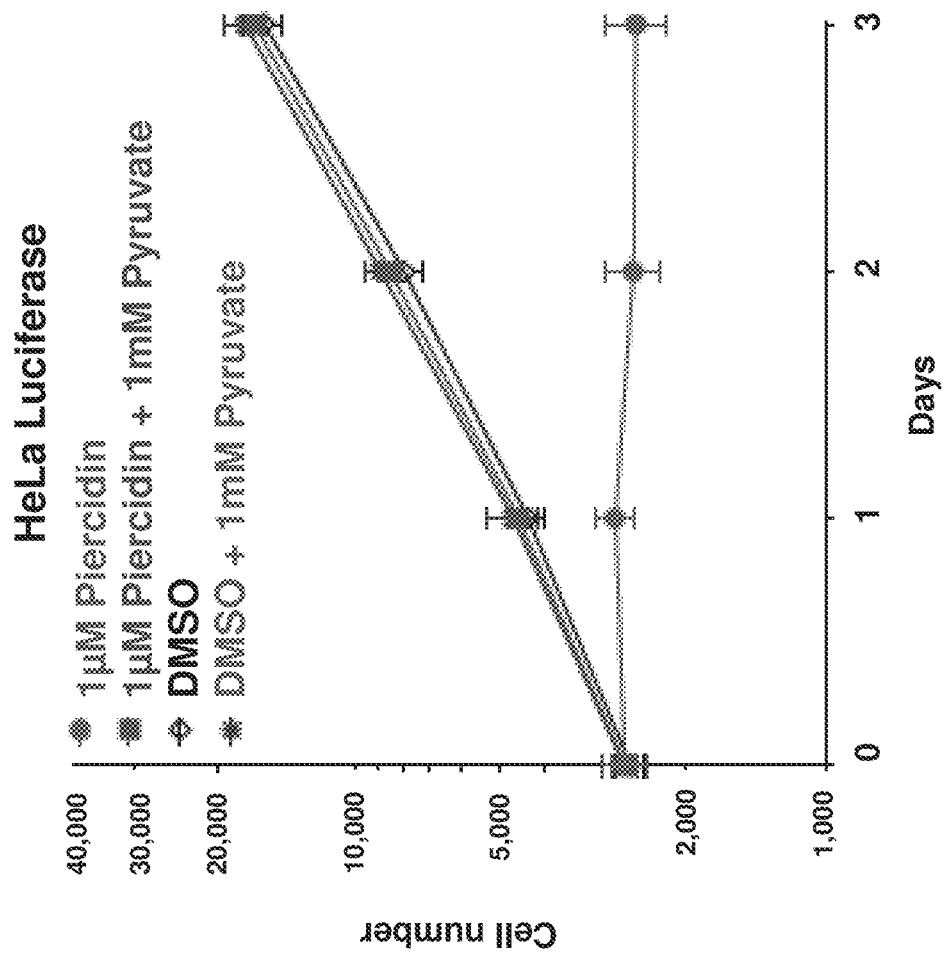
Figure 10J:
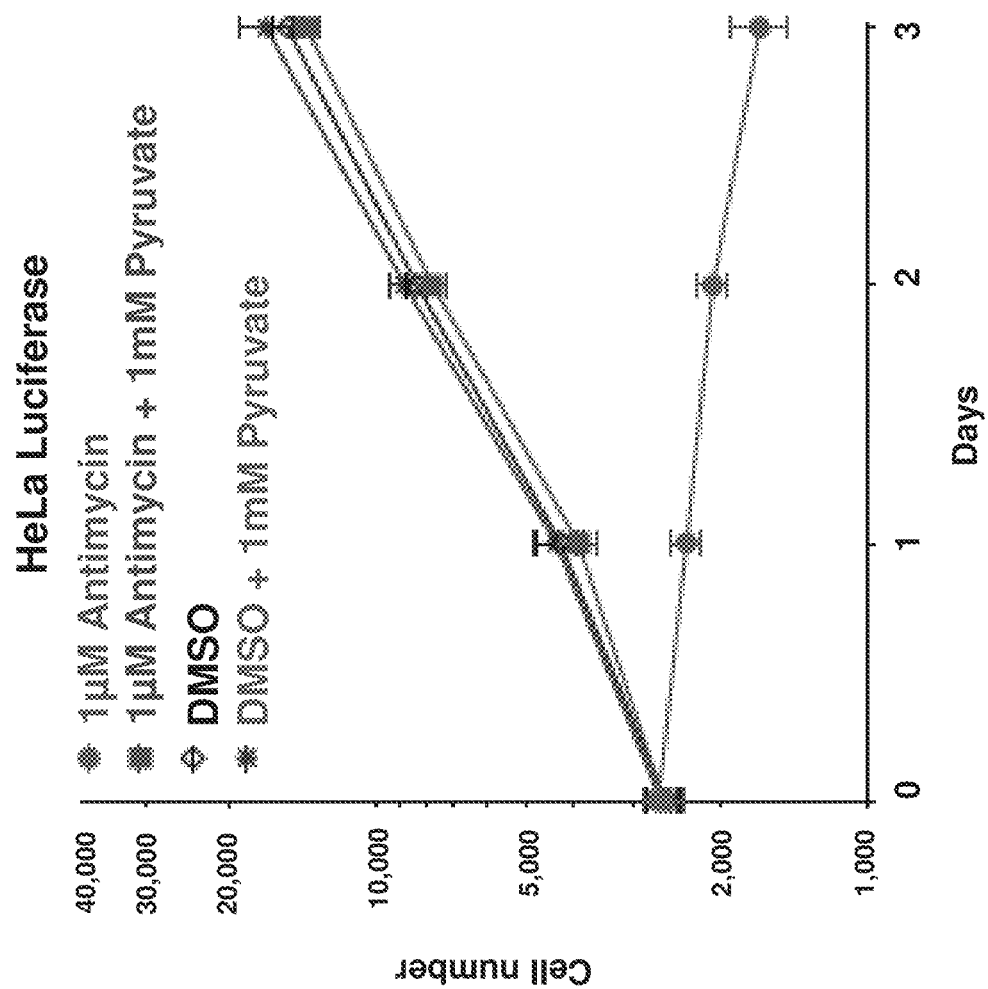
Figure 10K:
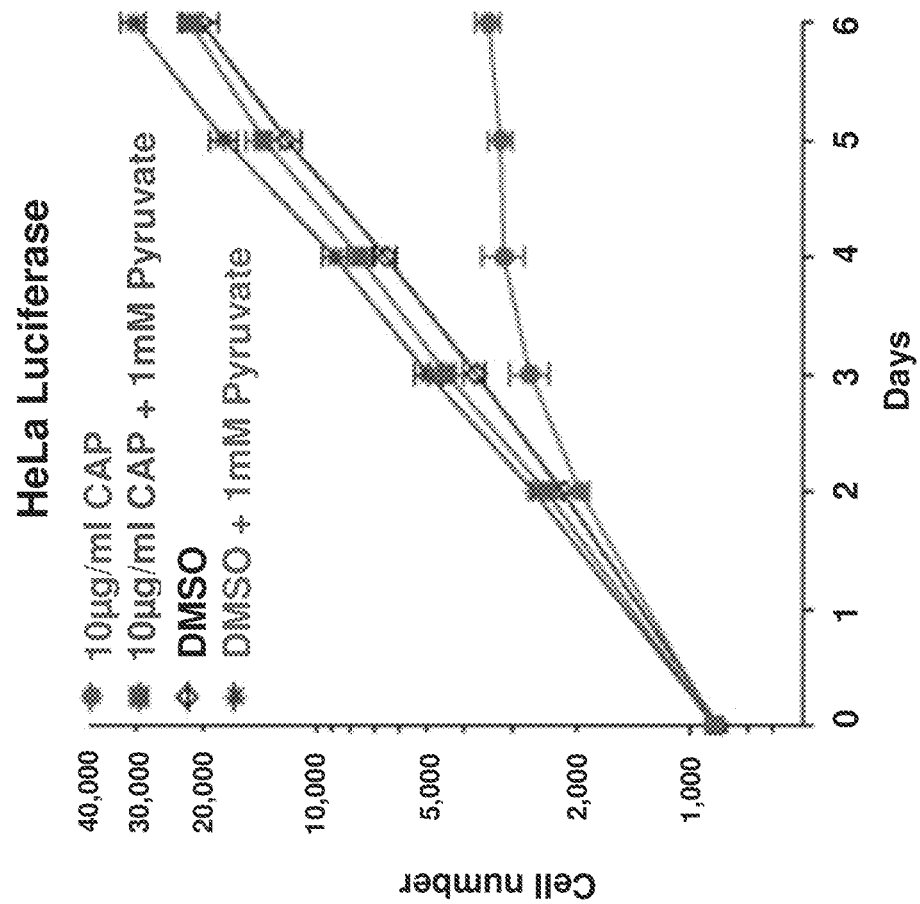
Figure 10L:
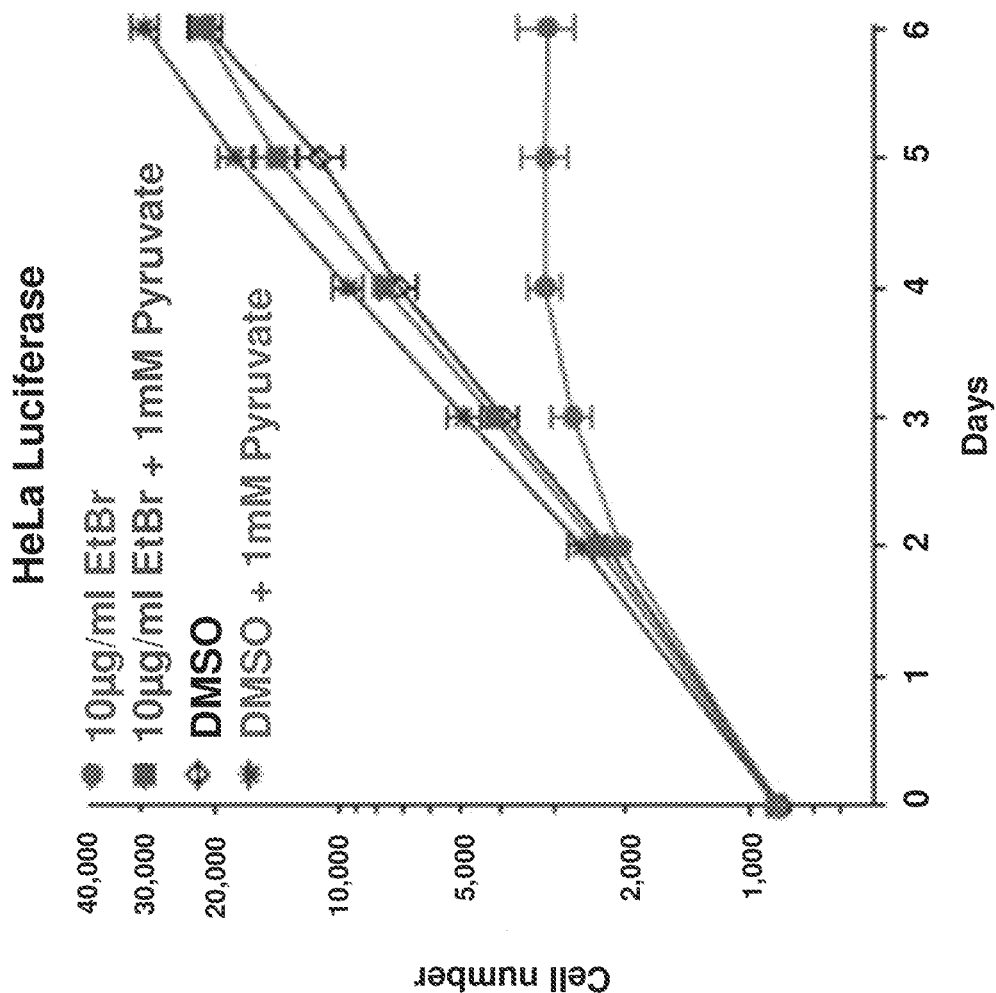
Figure 11A:
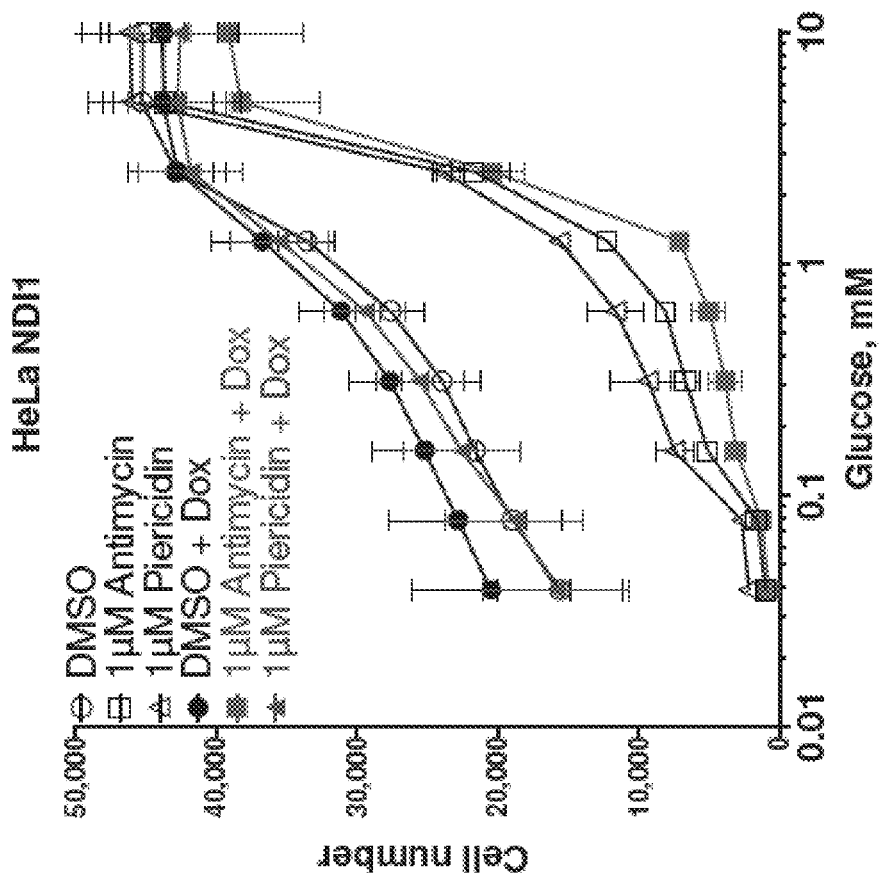
FIGS. 11A-11D show the effect of yeast Ndi1 (FIG. 11A), Luciferase (FIG. 11B), LbNOX (FIG. 11C) and mitoLbNOX (FIG. 11D) expression on HeLa Tet3G NDI1, Luciferase, LbNOX and mitoLbNOX cell survival, respectively, in the presence of antimycin or piericidin at varying glucose concentrations. Mean values±S.E.M. (error bars) from three independent experiments are shown.
Figure 11B:
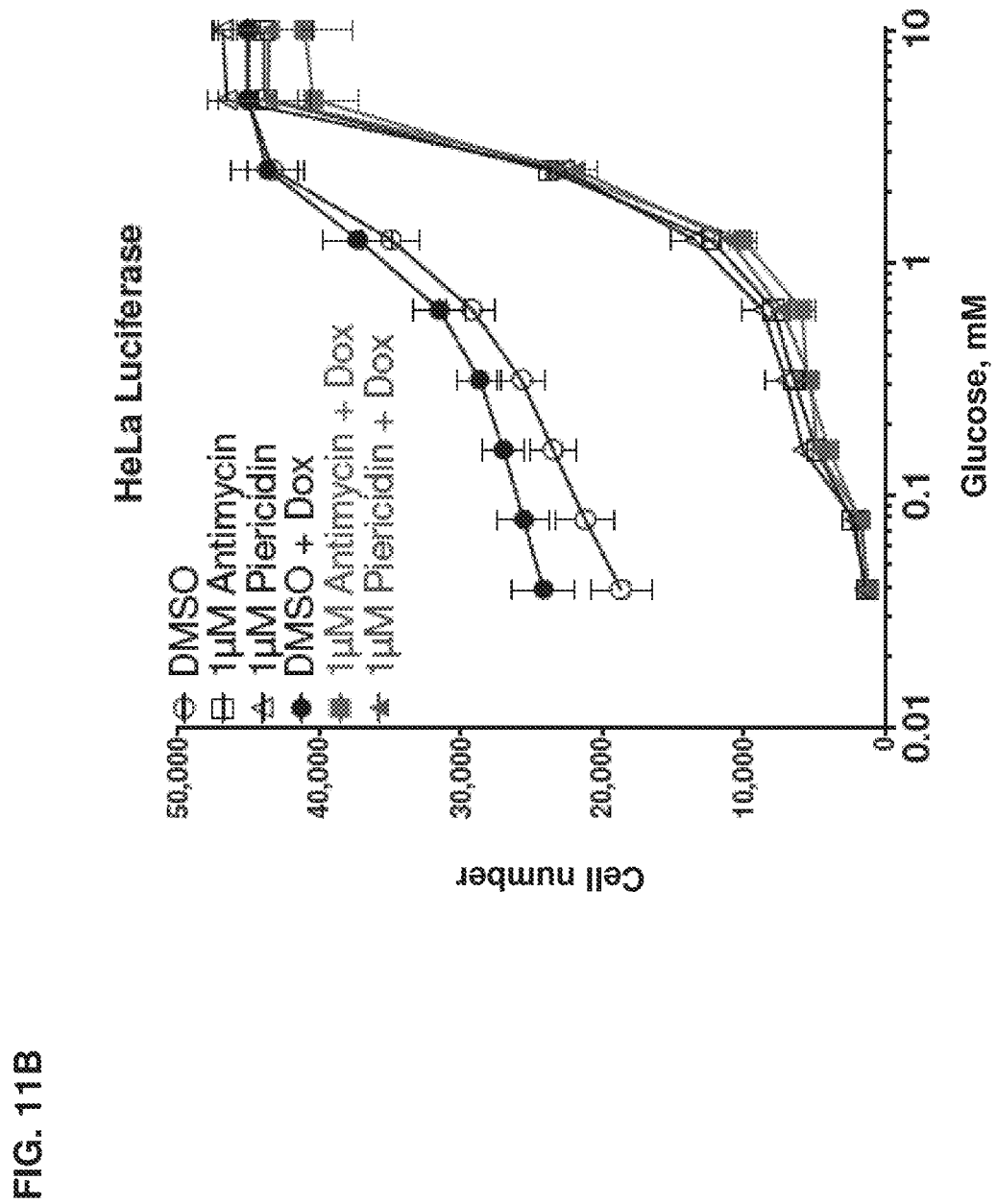
Figure 11C:
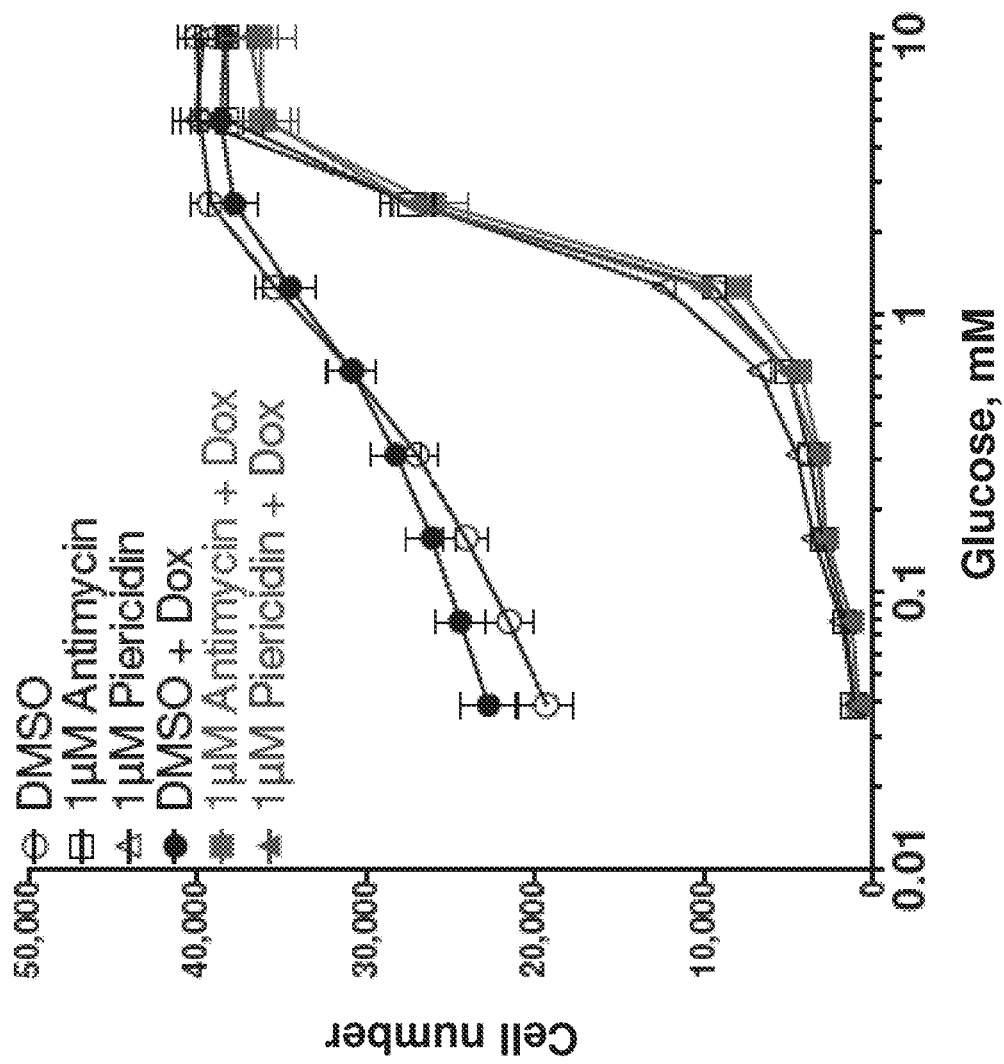
Figure 11D:
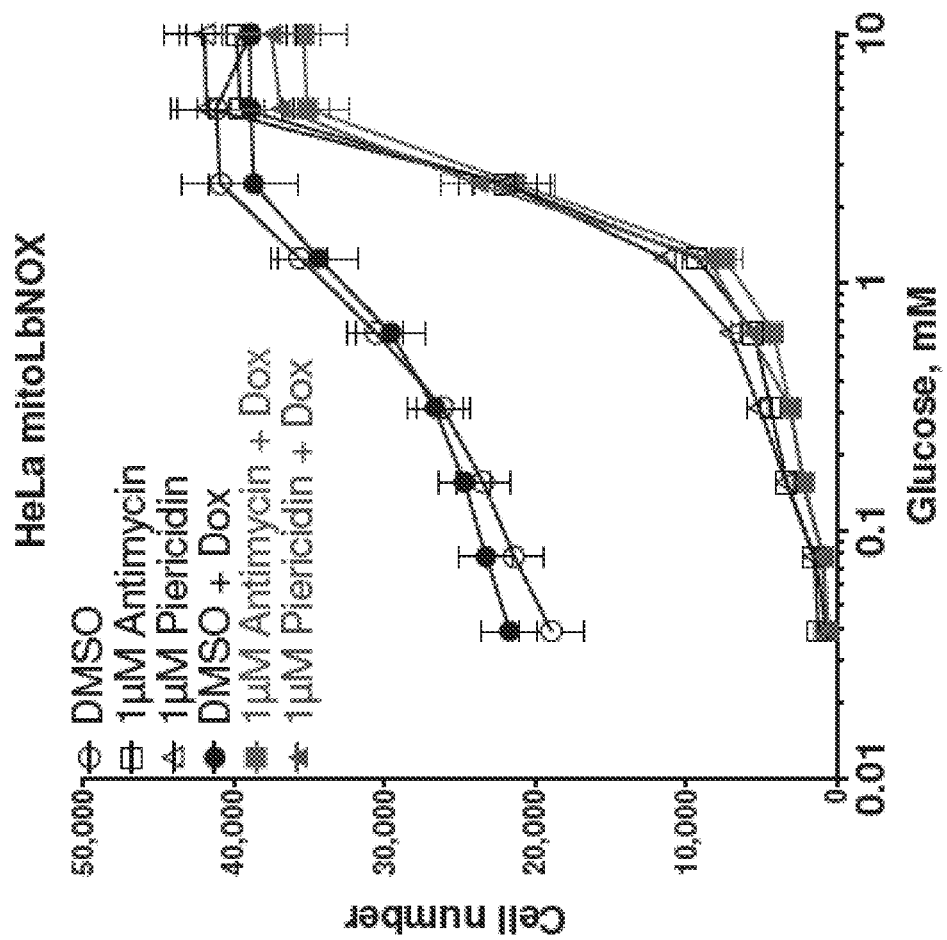

Example 5. Water-Forming NADH Oxidase Activity Dictates the Phosphorylation State of Pyruvate Dehydrogenase Complex in Mammalian Cells LbNOX is also capable of modulating the phosphorylation state of pyruvate dehydrogenase complex (PDH), which is known to be regulated by $NAD^+$/NADH based on in vitro studies. As shown in FIGS. 3C and 9D, mitoLbNOX was capable of inducing the dephosphorylation of PDH, thus confirming the physiological impact of compartment-specific perturbation of mitochondrial $NAD^+$/NADH by mitoLbNOX. This example demonstrates that PDH activity is regulated by mitochondrial $NAD^+$/NADH in vivo, and underscores the ability of water-forming NADH oxidases to modulate metabolic activity in a compartment-specific manner. This is the first time this activity has been shown in vivo.

Figure 3D:
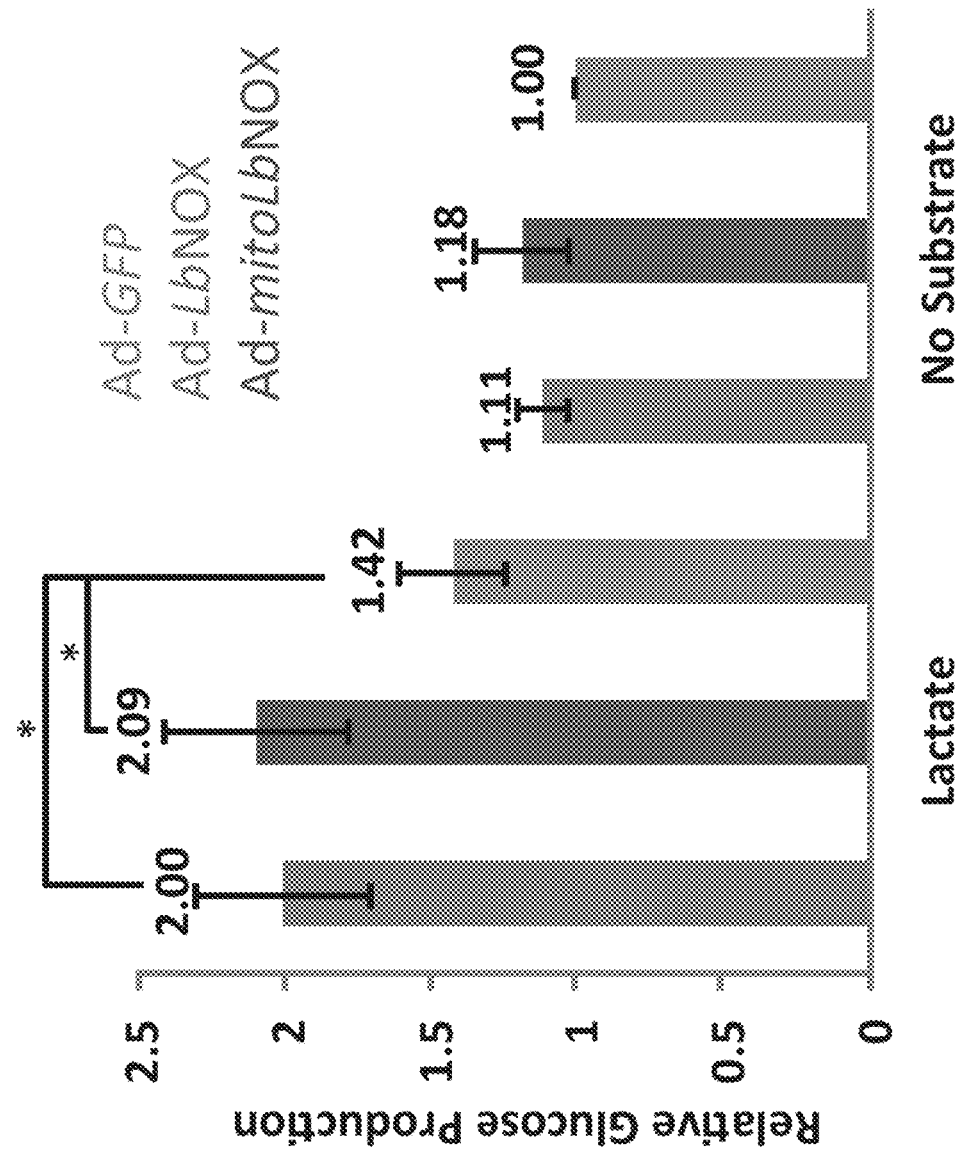

Example 6. Water-Forming NADH Oxidases Potentiate Gluconeogenesis in Mammalian Cells As a result of its ability to elevate the intracellular ratio of $NAD^+$ to NADH, LbNOX is also capable of potentiating gluconeogenesis in mammalian cells (e.g., human cells). The first step of gluconeogenesis from lactate is the conversion of lactate to pyruvate, which requires cytosolic $NAD^+$. Gluconeogenesis from lactate was significantly increased when primary hepatocytes were transduced with either LbNOX or mitoLbNOX-containing adenovirus (FIG. 3D). The effect of LbNOX and mitoLbNOX on gluconeogenesis was commensurate to their effect on lactate/pyruvate ratio (FIG. 3B), suggesting that cytoplasmic and not mitochondrial $NAD^+$/NADH is important for regulation of gluconeogenesis rate from lactate. These examples demonstrate the ability of water-forming NADH oxidases to control the rate of gluconeogenesis upon introducing these enzymes to mammalian cells.

Figure 4A:
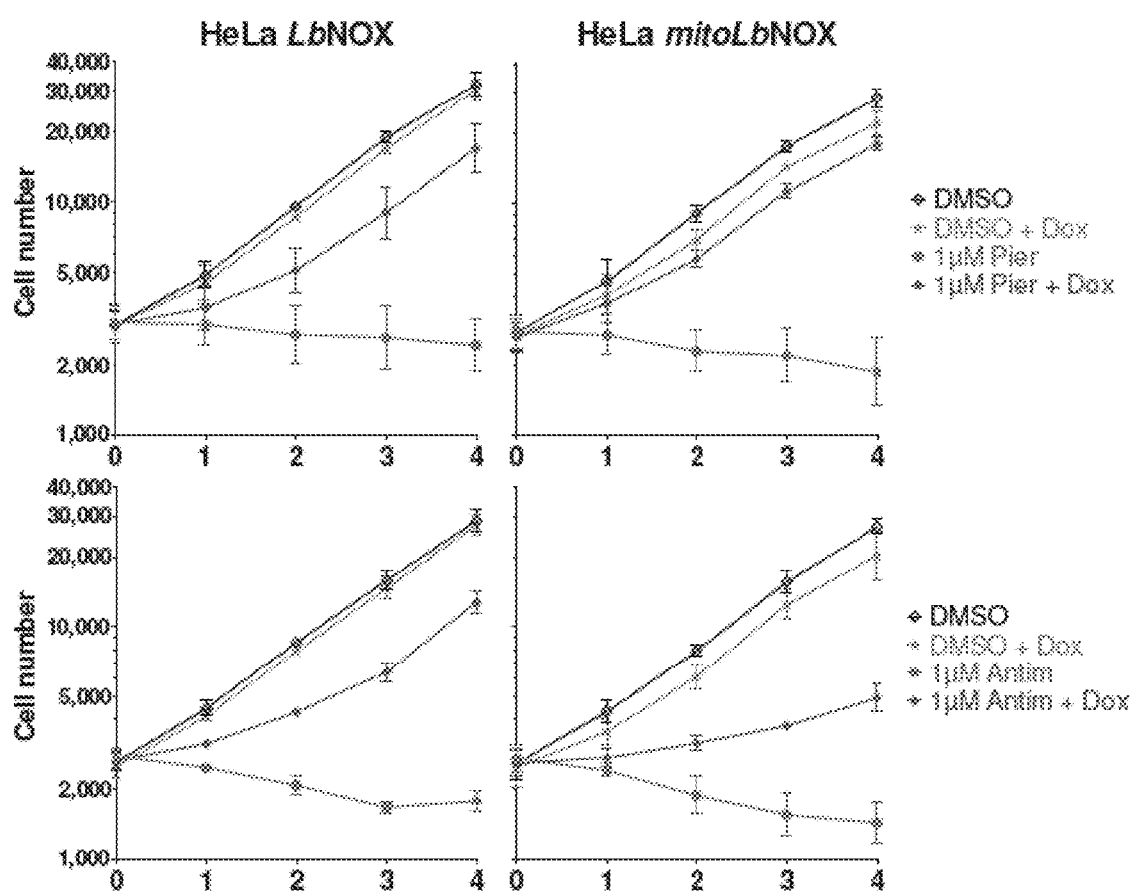
FIGS. 4A and 4B demonstrate that LbNOX fully complements ETC function required for mammalian cell proliferation.
Figure 4A:
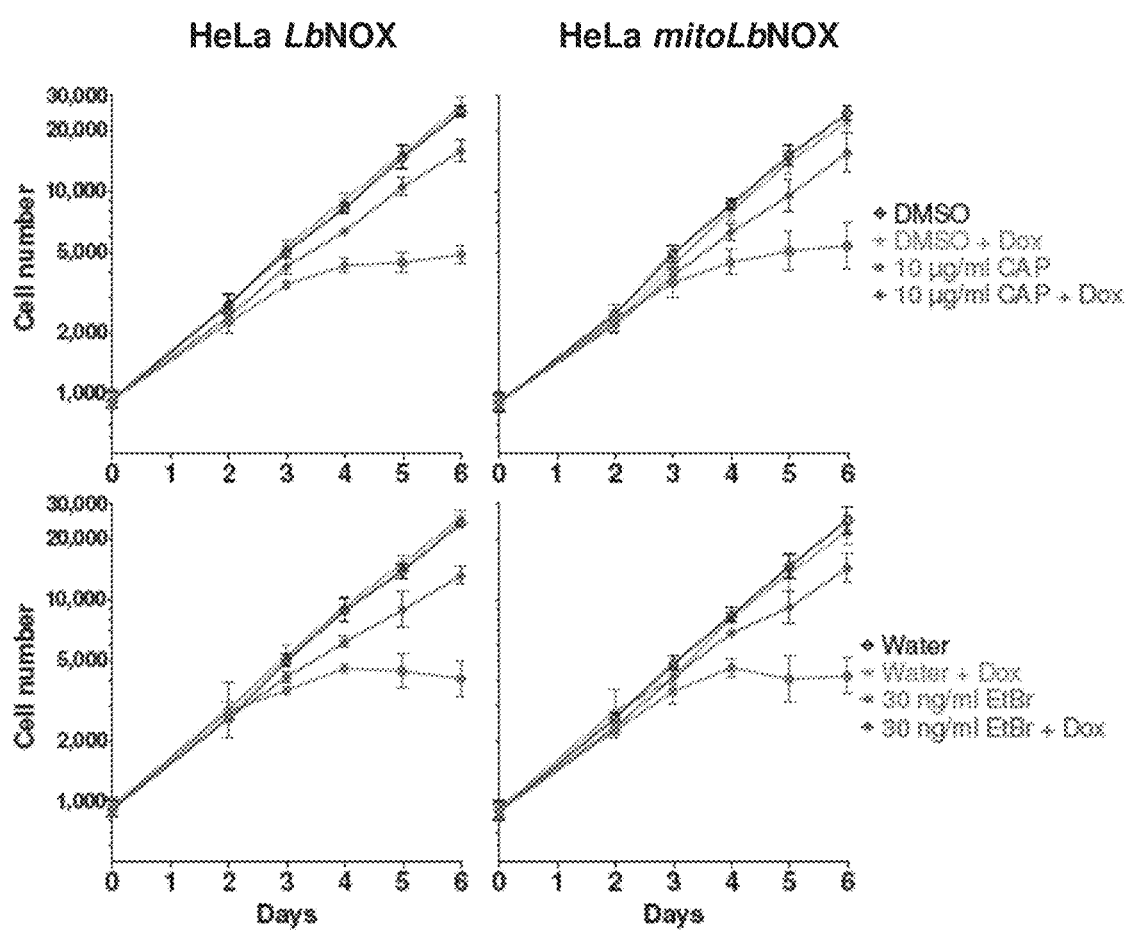
Figure 4B:
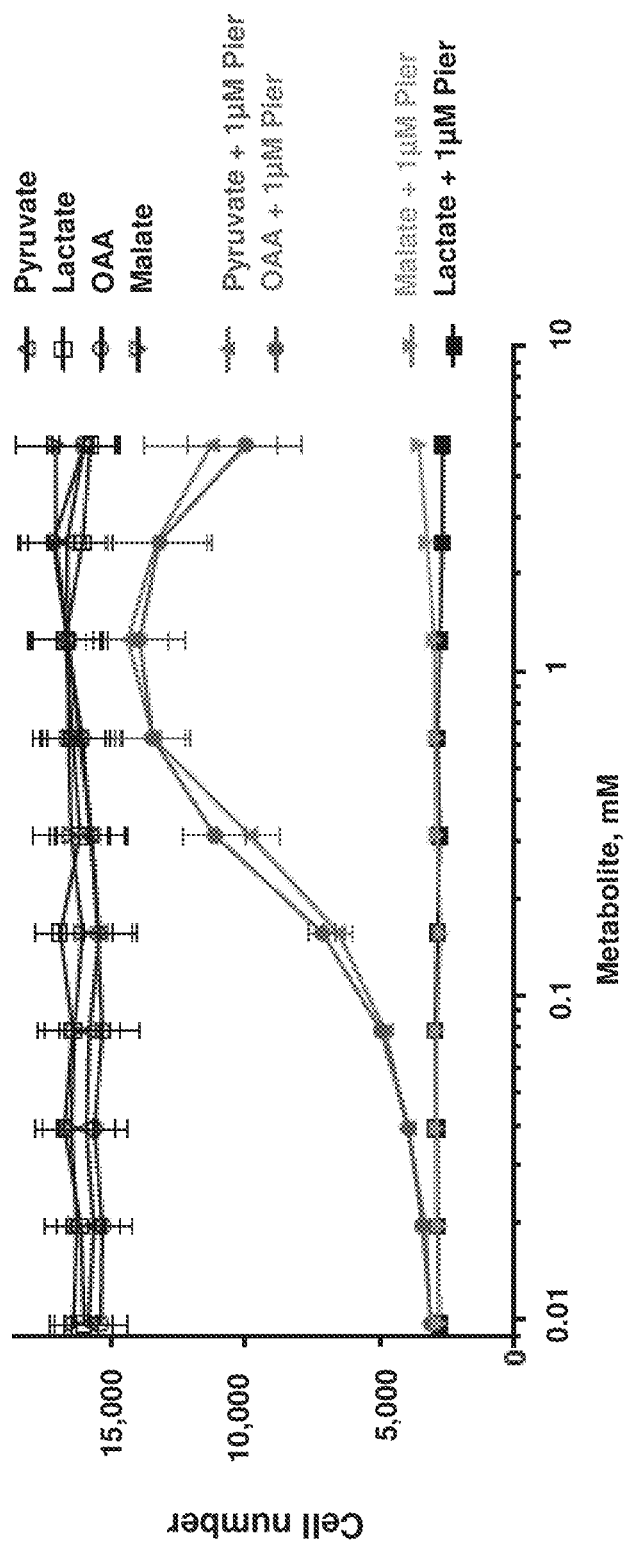

Example 7. Water-Forming NADH Oxidases Restore the Ability of Mammalian Cells to Proliferate in the Presence of Mitochondrial Respiratory Chain Inhibitors It has been known for years that mammalian cells that lack mitochondrial DNA (mtDNA) require the addition of exogenous pyruvate and uridine for cell proliferation. Uridine is thought to be required because one of the enzymes in de novo uridine biosynthesis (DHODH—dehydroorotate dehydrogenase) is Coenzyme Q (CoQ)-dependent, and thus requires a functional respiratory chain for activity. The requirement of pyruvate is not well understood because it has so many fates and participates in so many reactions. It has been proposed that pyruvate might work by stimulating $NAD^+$ recycling via cytosolic lactate dehydrogenase. While an attractive explanation, this hypothesis has never been rigorously evaluated because of a lack of methods to specifically promote $NAD^+$ recycling in the absence of respiratory chain activity. This hypothesis was tested directly by introducing LbNOX to mammalian cells that contain functionally deficient respiratory chains. In order to inhibit respiratory chain activity, mammalian cells were treated with piericidin (a complex I inhibitor), antimycin (a complex III inhibitor), ethidium bromide (a mtDNA replication inhibitor) and chloramphenicol (a mitochondrial translation inhibitor). HeLa cells are incapable of proliferating in the presence of these inhibitors without supplementation by pyruvate and uridine (FIG. 4 and FIG. 10). Both LbNOX and mitoLbNOX rescued the proliferation defect caused by all of these inhibitors. The growth rate was rescued completely as judged by the slope of logarithmic growth curves at the end of the experiment, except for the rescue of antimycin effect by mitoLbNOX, which was partial (FIG. 4A). Under several conditions tested there was a lag of about two days when LbNOX and mitoLbNOX expressing cells proliferated slower than cells with intact respiratory chain. These data suggest that $NAD^+$ recycling is an essential function of the respiratory chain that is required for mammalian cell proliferation and that water-forming NADH oxidases, such as LbNOX, can alleviate the reductive stress associated with respiratory chain inhibition. As a control, we tested whether LbNOX and mitoLbNOX expression had any effect on the proton pumping and ATP synthesis functions of the respiratory chain in the presence of established inhibitors. We used cell survival in the presence of low glucose concentrations as a readout of respiratory chain-derived ATP synthesis, which is driven by the proton pumping function of the respiratory chain. Both LbNOX and mitoLbNOX had no effect on a decrease in cell number in the presence of piericidin or antimycin at low glucose concentrations (FIG. 11). The yeast Ndi1 protein, which can restore both $NAD^+$ recycling and proton pumping at complexes III and IV in the presence of piericidin, was used as a positive control. Ndi1 rescued the effect of piericidin but not other ETC inhibitors on both cell proliferation and cell survival at low glucose concentrations (FIG. 10 and FIG. 11).

Figure 12:
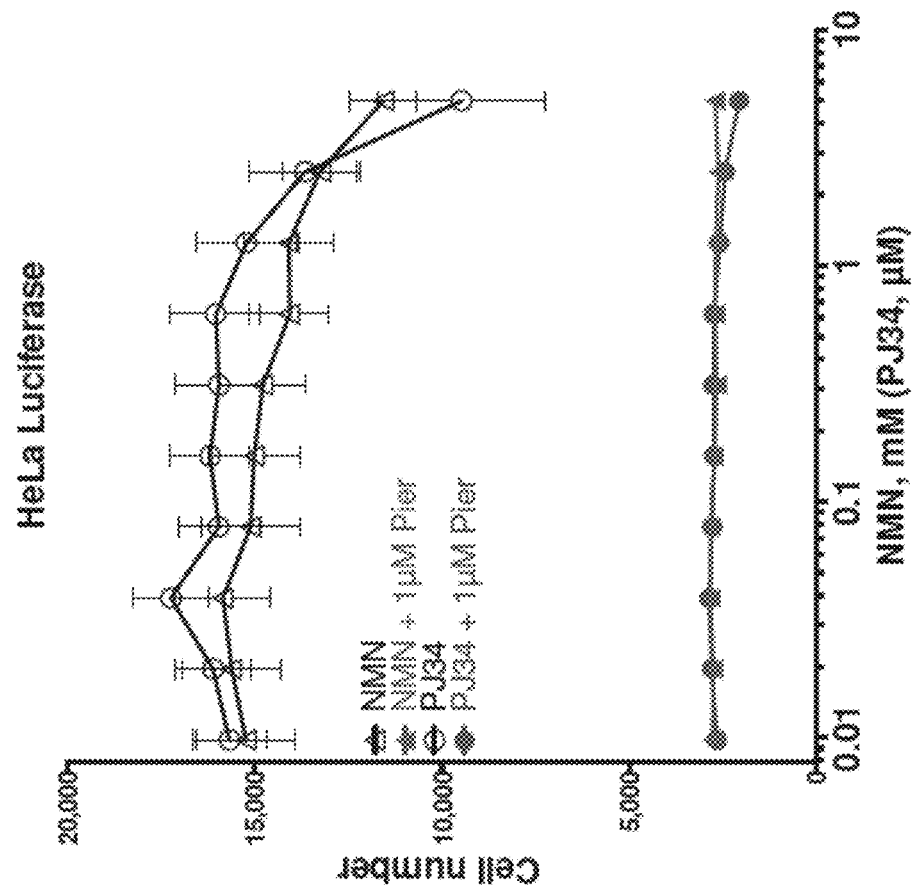
FIG. 12 shows the effect of NMN and PJ34 on piericidin induced proliferative defect in HeLa Tet3G Luciferase cells. Mean values±S.E. (error bars) from five independent experiments are shown.

The above experiments, employing LbNOX as a genetic tool, clearly demonstrate that $NAD^+$ recycling is an important function of the respiratory chain required for mammalian cell proliferation. In order to further validate this hypothesis, we tested whether other metabolites in addition to pyruvate can rescue the proliferation defect induced by ETC impairment. If the $NAD^+$ recycling hypothesis is correct then supplementation with oxaloacetate should also rescue the proliferation defect, whereas supplementation with either lactate or malate should not. Oxaloacetate should have the same effect as pyruvate because it can be reduced to malate by malate dehydrogenase while recycling $NAD^+$. In agreement with the hypothesis, the data clearly show that both pyruvate and oxaloacetate rescue the proliferation defect induced by piericidin while lactate and malate do not (FIG. 4E). Recent studies have shown that in animal models of mitochondrial disease, supplementation with precursors to $NAD^+$ biosynthesis (or alternatively, blockade of $NAD^+$ catabolism) can retard disease progression. At present, mechanistic basis for this protective effect is not known. The $NAD^+$ precursor PMN and poly ADP ribose polymerase (PARP) inhibitor PJ34 did not rescue piericidin induced proliferation defect (FIG. 12), indicating that these interventions act by mechanisms distinct from $NAD^+$ recycling.

Figure 13:
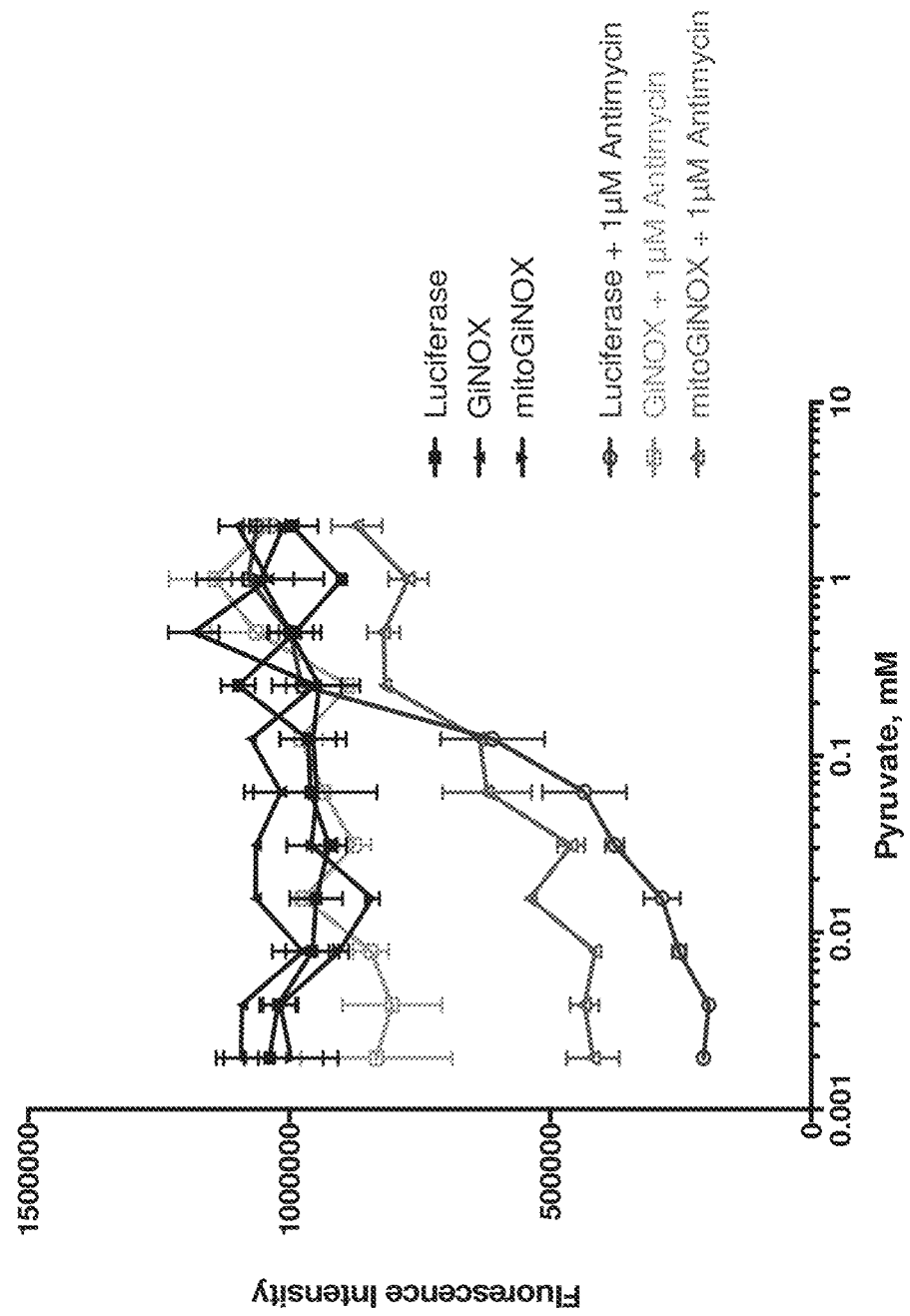
FIG. 13 shows the effect of expression of Luciferase, a water-forming NADH oxidase from eukaryotic organism *Giardia intestinalis* (hereinafter "GiNOX"), or GiNOX fused to a mitochondrial targeting sequence (mitoGiNOX) on proliferation of HeLa Tet3G cells in the presence or absence of 1 µM antimycin and at various concentrations of pyruvate. Cell number was estimated using fluorescence intensity with CyQUANT cell proliferation kit. Cells were grown in DMEM media without pyruvate supplemented with 10% dialyzed FBS and Luciferase, GiNOX or mitoGiNOX expression was induced by addition of 1 µg/ml doxycycline.

Example 8. Water-Forming NADH Oxidases Derived from Eukaryotic Cells can Alleviate Pyruvate Auxotrophy in Mammalian Cells GiNOX, a water-forming NADH oxidase derived from *Giardia intestinalis*, and mitoGiNOX are capable of restoring the proliferation of mammalian cells cultured in pyruvate-depleted media and in the presence of antimycin, a complex III inhibitor. HeLa Tet3G cells cultured in the presence of varying concentrations of pyruvate demonstrated a diminished pyruvate-dependency in the presence of antimycin when GiNOX and mitoGiNOX were expressed in these cells (FIG. 13). Notably, both GiNOX and mitoGiNOX were capable of alleviating the pyruvate auxotrophy, which further illustrates that cytosolic water-forming NADH oxidases can ameliorate the effects of a defective respiratory chain, as these enzymes need not be targeted to the mitochondria in order to restore redox balance.

Example 9. Treatment of a Mitochondrial Disease in a Human Patient by Administration of a Water-Forming NADH Oxidase The water-forming NADH oxidases for use in the compositions and methods of the invention can be administered to a human patient in order to mitigate a disease caused by a dysfunctional mitochondrial respiratory chain or one or more of its symptoms. For instance, a human patient presenting with a disease caused by a dysfunctional complex I protein can be treated by administering one or more of the compositions of the invention that contain or encode a water-forming NADH oxidase by an appropriate route (e.g., intravenously) at a particular dosage (e.g., between 0.001 and 100 mg/kg/day) over a course of days, weeks, months, or years. If desired, the water-forming NADH oxidase can be modified, e.g., by hyperglycosylation or by conjugation with PEG, so as to evade immune recognition and/or to improve the pharmacokinetic profile of the enzyme.

The progression of the disease can be monitored by any of several methods. A physician can monitor the patient by direct observation in order to evaluate how the symptoms exhibited by the patient have changed in response to treatment. Optionally, cells can be extracted from the patient and a quantitative biochemical analysis can be conducted in order to determine the intracellular concentrations of certain metabolites and cofactors (e.g., NADH, $NAD^+$, glucose, pyruvate, lactate, etc). Based on the results of these analyses, a physician may prescribe higher or lower dosages of the water-forming NADH oxidase in subsequent rounds of treatment.

Example 10. Treatment of a Mitochondrial Disease in a Human Patient by Administration of a Human Cell Encoding a Water-Forming NADH Oxidase Another treatment regimen includes administering human cells that have been modified to express a water-forming NADH oxidase to a patient presenting with a disease, condition, or symptom associated with mitochondrial respiratory chain dysfunction. For example, autologous cells from a particular organ of a patient can be extracted and genetically modified ex vivo (e.g., using any of the methods or techniques described herein or known in the art) so as to express a water-forming NADH oxidase from the nuclear genome of the cell. The cell can then be re-administered to the patient in order to mitigate the disease, condition, or symptom of interest. Optionally, allogeneic cells from another human can be extracted, genetically modified to express a water-forming NADH oxidase, and subsequently administered to the patient.

In the case of allogeneic therapy, it may be desirable to obtain the cells from a close relative of the patient (e.g., a parent or sibling) in order to minimize allograft rejection by the patient. Another technique that can be employed in order to attenuate the immune response of the patient against allogeneic cells expressing water-forming NADH oxidases involves the genetic silencing of the major histocompatability complex (MHC) class I proteins. These molecules are presented on the surfaces of all somatic cells and represent one mechanism by which the immune system of a patient can recognize and clear foreign cells from the body. As such, it may be desirable to genetically alter allogeneic cells so as to express silencing RNA capable of preventing the translation of functional MHC proteins prior to administration of these cells to a patient. MHC-silenced allogeneic cells expressing a water-forming NADH oxidase can subsequently be administered to a patient in order to improve the survival and proliferation of these cells in vivo.

Example 11. Rational Design of a NADPH-Specific Water-Forming NADPH Oxidase

We developed a variant of LbNOX that was engineered to be specific for NADPH (referred to as TPNOX; SEQ ID NO: 329). This variant can be used as a genetically encoded tool for promoting a compartment-specific increase of $NADP^+/NADPH$ ratio in cells.

Several examples of engineering the NAD(P)H cofactor preference of various oxidoreductases have been described (Bernard et al. Biochemical and biophysical research communications 208:895-900 (1995); Mittl et al. Protein science: a publication of the Protein Society 3:1504-1514 (1994); Scrutton et al. Nature 343:38-43 (1990); Brondani et al. Journal of the American Chemical Society 136:16966-16969 (2014); Elmore et al. Journal of Biological Chemistry 277:48960-48964 (2002); Khoury et al. Protein science: a publication of the Protein Society 18:2125-2138 (2009); Rane et al. Archives of biochemistry and biophysics 338: 83-89 (1997); Rosell et al. Journal of Biological Chemistry 278:40576-40580; and Brinkmann-Chen et al. Proceedings of the National Academy of Sciences of the United States of America 110:10946-10951 (2013)). Based on the accumulated structural and biochemical data (Wallen et al. Biochemistry 47:5182-5193 (2008); Wallen et al. Biochemistry 54:6815-6829 (2015); and Petschacher et al. Computational and Structural Biotechnology Journal 9:e201402005 (2014)).

We mutated five (5) residues in LbNOX. These residues are located in both the dinucleotide-binding motif and in the cofactor specificity loop. The result was a quintuple mutant, TPNOX (see positions 1-5 of FIG. 14).

In TPNOX, neutral Ala177 in position 2 replaces negatively charged Asp in LbNOX to remove the charge repulsion with the phosphate moiety in the 2' position of NADPH. In positions 3 and 5, positively charged Arg178 and Arg184 were introduced, as they provide stabilizing electrostatic interactions with the phosphate group of NADPH. In position 3, Ser179 was introduced to provide a hydrogen bond donor for interaction with the phosphate group. Finally, a Gly to Ala mutation was included (position 1, FIG. 14) in order to retain the high enzymatic activity of TPNOX.

Figure 15:
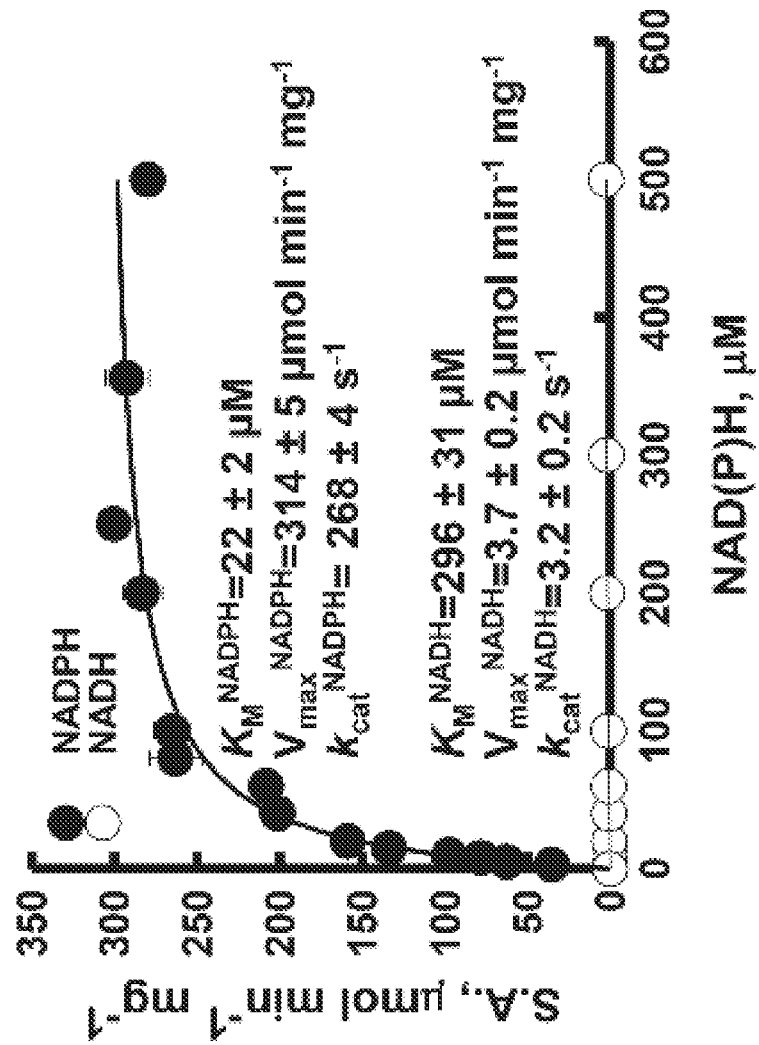
FIG. 15 shows a Michaelis-Menten analysis of the NADPH oxidation reaction catalyzed by TPNOX, which is a quintuple mutant (G159A/D177A/A178R/M179S/P184R) of LbNOX. TPNOX is highly specific towards NADPH (e.g., approximately 1120 fold more reactive with NADPH than with NADH based on respective kat/$K_M$ values).

The enzymatic properties of the engineered TPNOX were evaluated (FIG. 15), and this enzyme was found to be highly reactive with NADPH ($k_{cat}$ 268±4 s$^{-1}$) while virtually non-reactive with NADH ($k_{cat}$ 3.2±0.2 s$^{-1}$). The $K_M$ of TPNOX for NADPH (22±2 μM) is lower than the $K_M$ of LbNOX for NADH (69±3 μM). Effectively, TPNOX is 1120 fold more reactive with NADPH than with NADH based on respective $k_{cat}/K_M$ values, which represents unprecedented substrate specificity switch.

Figure 16A:
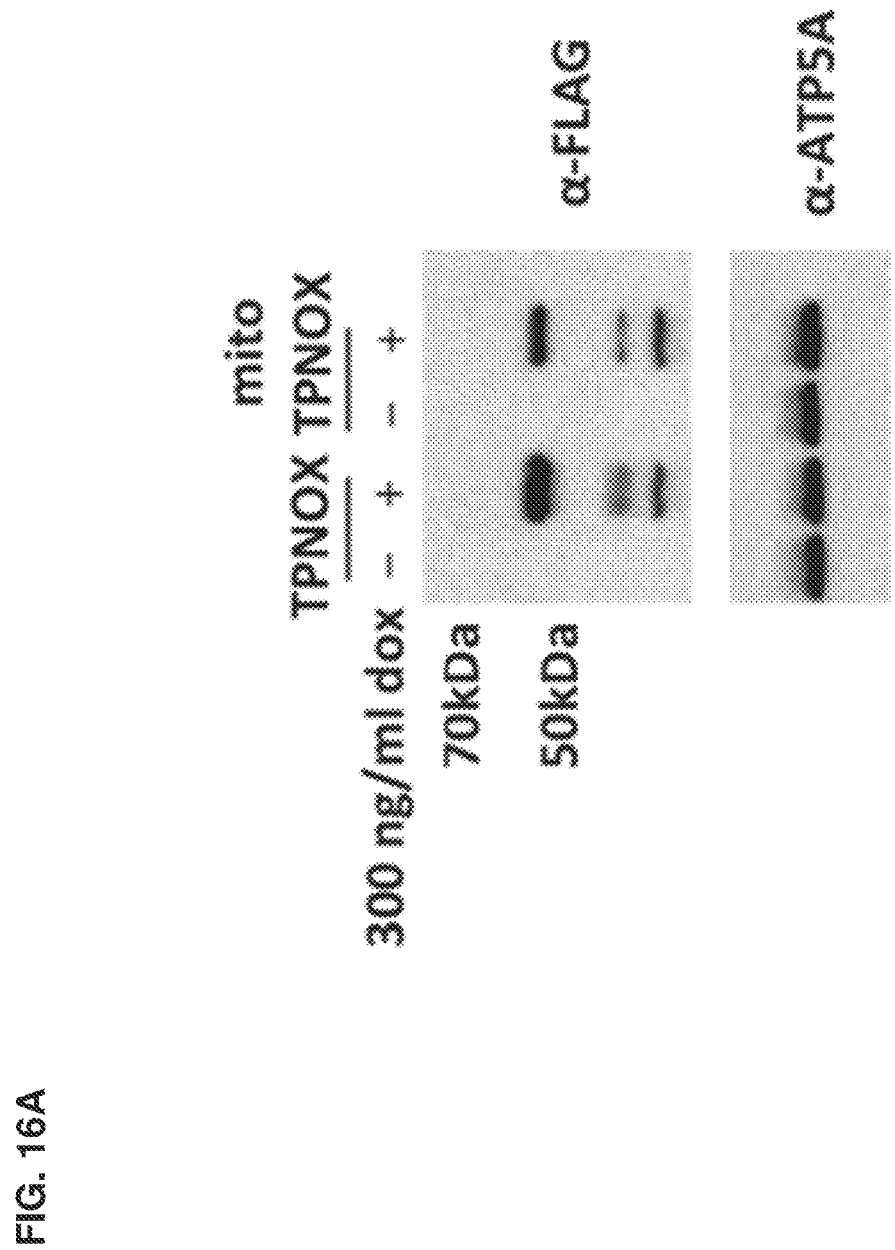
FIGS. 16A and 16B show the expression and activity of TPNOX and mitoTPNOX in HeLa cells, respectively.
Figure 16B:
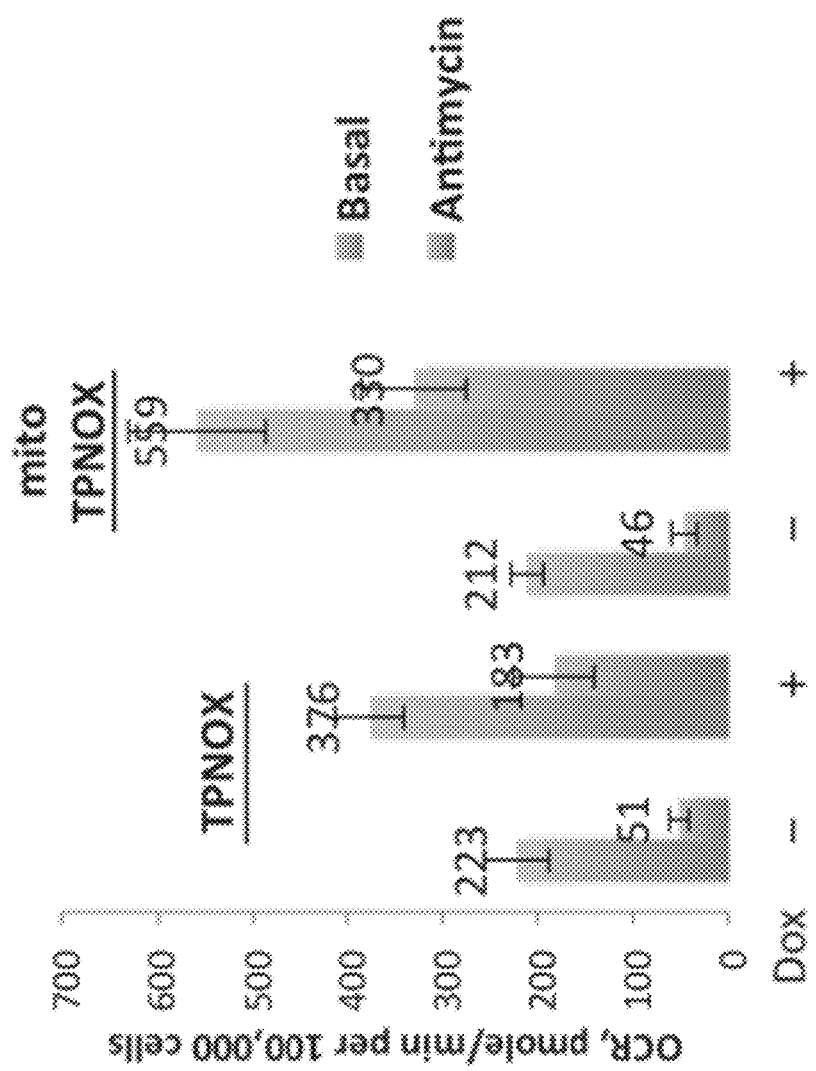

Lentiviral infection was used to generate HeLa cells that expressed untargeted or mitochondria-targeted TPNOX (referred to as TPNOX and mitoTPNOX, respectively) under the control of a doxycycline-inducible promoter (TRE3G) (FIG. 16A). Expression of TPNOX and mitoTPNOX in HeLa cells is safely tolerated, without an obvious impact on cell morphology, viability, or proliferation. Expression of TPNOX and mitoTPNOX increased oxygen consumption by 1.7 and 2.6-fold, respectively (FIG. 16B), demonstrating that the enzymes are active in human cells. The increase in oxygen consumption was resistant to the electron transport chain inhibitor, antimycin, indicating that it is due to TPNOX activity and not due to increased electron transport chain activity. These data indicate that TPNOX and mitoTPNOX can be targeted to different compartments of human cells where they retain their activity.

In summary, rational mutagenesis was used to design the first water-forming NADPH oxidase, TPNOX, with exceptional specificity for NADPH. We validated its specificity for NADPH vs. NADH and showed that TPNOX is active when expressed in HeLa cells. In the same way that LbNOX is useful for studying the role of NAD$^+$/NADH in cell physiology and disease, TPNOX and other NADPH-specific water-forming NADPH oxidases designed using this platform represent valuable genetic tools for studying the role of compartment-specific changes of NADP$^+$/NADPH ratio in physiology and disease.

Example 12. Water-Forming NADPH Oxidases can Manipulate the Mitochondrial NAD$^+$:NADH Ratio and Rescue Proliferation of Mammalian Cells in the Presence of a Complex I Inhibitor Water-forming NADPH oxidases, such as TPNOX and mitoTPNOX, can be used as protein therapeutics for the treatment of disorders caused by excess production of NADH or NADPH or insufficient consumption of NADPH. Furthermore, mitoTPNOX expression can induce similar biochemical effects as those induced by mitoLbNOX expression. This is due in part to the connection between NAD$^+$/NADH and NADP$^+$/NADPH pools in the mitochondria through the action of several enzymes, including transhydrogenase (NNT) and glutamate dehydrogenase (GDH). Therefore, manipulation of the mitochondrial NADP$^+$/NADPH ratio by mitoTPNOX can lead to manipulation of the mitochondrial NAD$^+$/NADH ratio.

Figure 17A:
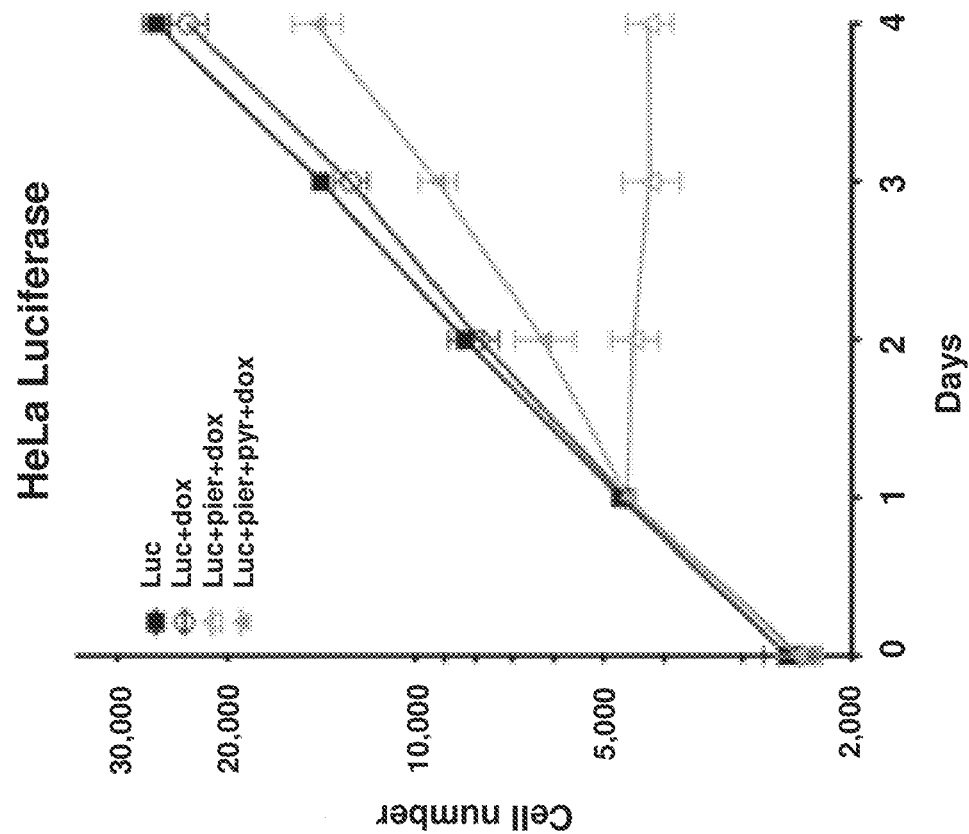
FIGS. 17A-17C are graphs showing that mitoTPNOX expression complements electron transport chain function required for mammalian cell proliferation. Doxycycline (dox)-inducible expression of mitoTPNOX (FIG. 17C) but not TPNOX (FIG. 17B) or luciferase (FIG. 17A) rescues proliferative defect of HeLa cells caused by treatment with 1 µM of Complex I inhibitor piericidin (pier). Mean±SEM from n=4 independent experiments.
Figure 17B:
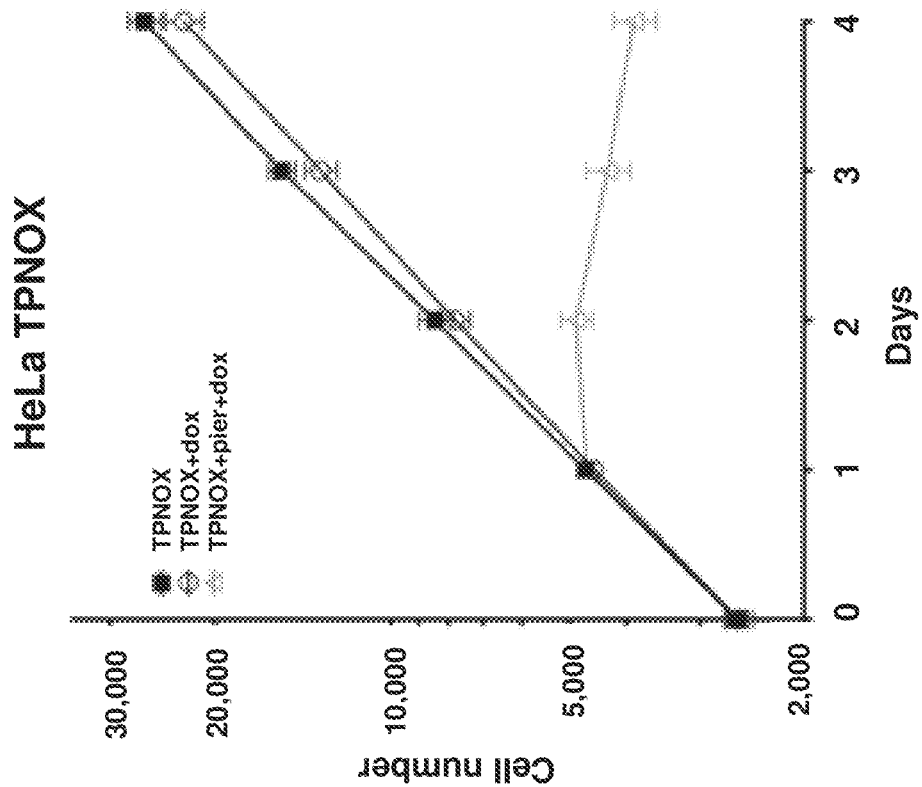
Figure 17C:
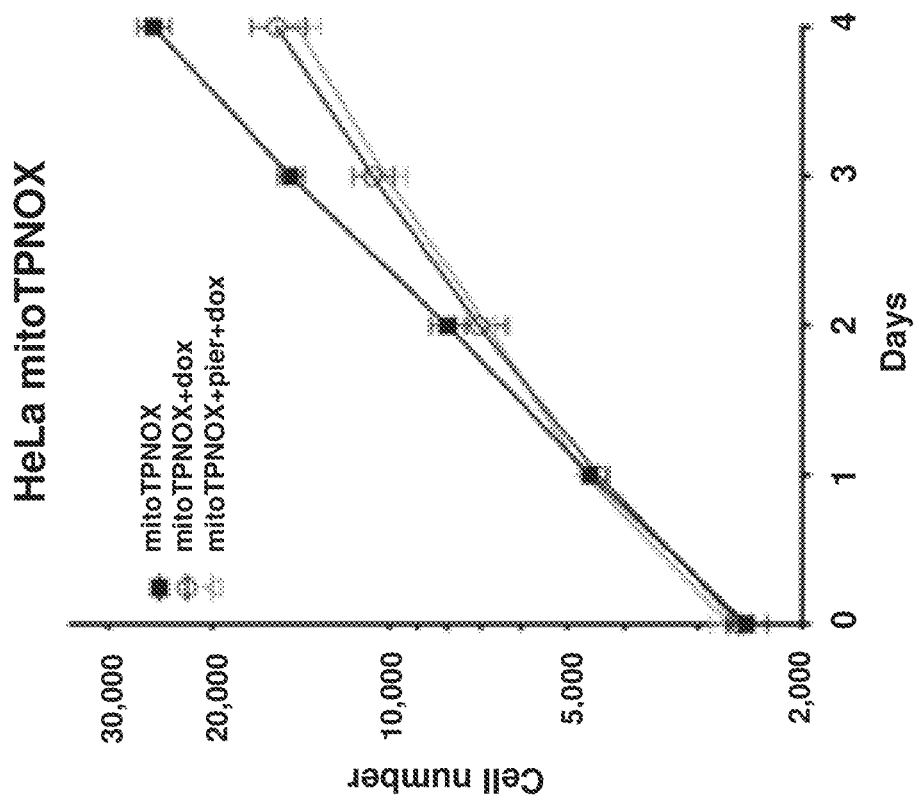

An example of this biological activity is shown in FIGS. 17A-C, which present graphs showing that expression of mitoTPNOX rescues proliferation of mammalian cells in the presence of piericidine, which is an inhibitor of Complex I of the mitochondrial electron transport chain. This rescue may be the result of indirect manipulation of the mitochondrial NAD$^+$/NADH ratio by mitoTPNOX. Therefore, mitoTPNOX (like LbNOX and mitoLbNOX) can be used as a protein therapeutic for the treatment of mitochondrial disorders caused by the overproduction of NADH.

Materials and Methods

One thousand HeLa Tet3G Luciferase, TPNOX, or mitoTPNOX cells were seeded in 200 μl of DMEM (DMEM (US Biological, D9800), 3.7 g/L NaHCO$_3$, 10% dialyzed FBS (Life Technologies, 26400-044)) per well in a black 96-well plate with a clear bottom (Corning, 3904). Twenty four hours after seeding, 10 μl of 6 μg/ml doxycycline (300 ng/ml final concentration) or water was added to each well. Twenty four hours after addition of doxycycline, media was exchanged to DMEM without pyruvate (DMEM (US Biological, D9802), 15.9 mg/L phenol red, 3.7 g/L NaHCO$_3$, 10% dialyzed FBS (Life Technologies, 26400-044)), ±1 μM piericidin, ±1 mM pyruvate and ±300 ng/ml doxycycline. After 0, 1, 2, 3 and 4 days, media was aspirated and cells were fixed by adding 100 μl of 4% paraformaldehyde in PBS and incubating at room temperature for at least 30 min. The paraformaldehyde solution was aspirated and the cells were stained with 200 μl of 1 μg/ml Hoechst 33345. Plates were covered with sealing aluminum foil and stored at 4° C. before counting cells in each well with Molecular Dynamics IMAGEXPRESS® Ultra (see "Nuclei counting using Molecular Devices IMAGEXPRESS® Ultra").

OTHER EMBODIMENTS

All publications, patents, and patent applications mentioned in this specification are incorporated herein by reference to the same extent as if each independent publication or patent application was specifically and individually indicated to be incorporated by reference.

While the invention has been described in connection with specific embodiments thereof, it will be understood that it is capable of further modifications and this application is intended to cover any variations, uses, or adaptations for use in the compositions and methods of the invention following, in general, the principles for use in the compositions and methods of the invention and including such departures from the present disclosure that come within known or customary practice within the art to which the invention pertains and may be applied to the essential features hereinbefore set forth, and follows in the scope of the claims.

Other embodiments are within the claims.

SEQUENCE LISTING (331 sequences)

SEQ ID NO: 1 - protein, 449 aa, Lactobacillus brevis
KVTVVGCTHAGTFAIKQILAEHPDAEVTVYERNDVISFLSCGIALYLGGKVADPQGLFYSSPEELQKLGANVQMNHNVLAIDPDQKTVTVEDLTNHAQTTESYDKLVMTSGSWPIVPKIPGIDSDRVKLCKNWAHAQALIEDAKEAKRITVIGAGYIGAELAEAYSTTGHDVTLIDAMARVMPKYFDADFTDVIEQDYRDHGVQLALGETVESFTDSATGLTIKTDKNSYETDLAILCIGFRPNTDLLKGKVDMAPNGAIITDDYMRSSNPDIFAAGDSAAVHYNPTHQNAYIPLATNAVRQGILVGKNLVKPTVKYMGTQSSSGLALYDRTIVSTGLTLAAAKQQGLNAEQVIVEDNYRPEFMPSTEPVLMSLVFDPDTHRILGGALMSKYDVSQSANTLSVCIQNENTIDDLAMVDMLFQPNFDRPFNYLNILAQAAQAKVAQSVNA

SEQ ID NO: 2 - protein, 445 aa, Lactococcus lactis
KIVVIGTNHAGIATANTLLEQYPGHEIVMIDRNSNMSYLGCGTAIWVGRQIEKPDELFYAKAEDFEAKGVKILTETEVSEIDFANKKVYAKTKSDDEIIEAYDKLVLATGSRPIIPNLPGKDLKGIHFLKLFQEGQAIDAEFAKEKVKRIAVIGAGYIGTEIAEAAKRRGKEVLLFDAENTSLASYYDEEFAKGMDENLAQHGIELHFGELAKEFKANEEGYVSQIVTNKATYDVDLVINCIGFTANSALASDKLATFKNGAIKVDKHQQSSDPDVYAVGDVATIYSNALQDFTYIALASNAVRSGIVAGHNIGGKELESVGVQGSNGISIFGYNMTSTGLSVKAAKKLGLEVSFSDFEDKQKAWFLHENNDSVKIRIVYETKSRRIIGAQLASKSEIIAGNINMFSLAIQEKKTIDELALLDLFFLPHFNSPYNYMTVAALNAK

SEQ ID NO: 3 - protein, 458 aa, Streptococcus pneumoniae
SKIVVVGANHAGTACINTMLDNFGNENEIVVFDQNSNISFLGCGMALWIGEQIDGAEGLFYSDKEKLEAKGAKVYMNSPVLSIDYDNKVVTAEVEGKEHKESYEKLIFATGSTPILPPIEGVEIVKGNREFKATLENVQFVKLYQNAEEVINKLSDKSQHLDRIAVVGGGYIGVELAEAFERLGKEVVLVDIVDTVLNGYYDKDFTQMMAKNLEDHNIRLALGQTVKAIEGDGKVERLITDKESFDVDMVILAVGFRPNTALADGKIELFRNGAFLVDKKQETSIPGVYAVGDCATVYDNARKDTSYIALASNAVRTGIVGAYNACGHELEGIGVQGSNGISIYGLHMVSTGLTLEKAKAAGYNATETGFNDLQKPEFMKHDNHEVAIKIVFDKDSREILGAQMVSHDIAISMGIHMFSLAIQEHVTIDKLALTDLFFLPHFNKPYNYITMAALTAEK

SEQ ID NO: 4 - protein, 456 aa, Streptococcus mutans
SKIVIVGANHAGTAAINTVLDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSRDFEATLKNLQFVKLYQNAEDVINKLQDKTQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 5 - protein, 451 aa, Serpulina hyodysenteriae
KVIVIGCNHAGTWAAKTLKATDPNCQVVTYDRNDNISFLACGIALWVGGVVKDPKGLFYASPESLRGEGIDVYMGHDVTKIDWANKKLCVKELKTGKEFEDTYDKLILATGSWPVTPPIEGLKQEGTTYGLKKGIFFSKLYQQGQEIIDEIAKPDVKKVMVVGAGYIGVELIEAFKNHGKEVILMEAMPRVMANYFDKEITDEAEKRIKEAGIEMHLGETVKKFEGDDRVKKVVTDKGSYDVDMVVMSVGFRPNNELYKDYLETLPNGAIVVDTTMKTTKDPDVFAIGDCATVYSRASEKQEYIALSTNAVRMGIVAANNALGKHVEYCGTQGSNAICVFGYNMASTGWSEETAKKKGLKVKSNFFKDSERPEFMPTNEDVLVKIIYEEGSRRLLGAQIASKHNHAEAIHAFSLAIQNGMTVDQFALSDFFFLPHYNKPLSWMTMVAYTAK

SEQ ID NO: 6 - protein, 448 aa, Clostridium aminovalericum
MKIVVIGCTHAGTAAVKTILKENPEAEITIFERNDNISFLSCGIALYVGGVVKDPAGLFYSNPEELSKMGANVKIKHNVKSIDTKSKKVIAEDMNTGEEIEVSYDKLVNTTGSWPIIPPIPGIESKNILLCKNYDQANVIIRQTKDAKKIVIVGGGYIGIELVEAFQKSGKQVTLIDGLDRILNKYLDKEFTDILEDDLKKNGINLALDQCVKSFKANENGEVTSVETTKGEYEADMVILCVGFRPNNELLKGKVDMLPNDAIIVDEYMRTSDPDIFAAGDSCAVHYNPNGNYAYIPLATNAVRMGMLIGKNISTPKVKYRGTQSTSGLNLFGYNIGSTGVTVSGAPQIGLNVRSVIVKDNYRPEFMPTNEEIIMQLVYEVGTNRIVGGQVMSKYDITQSANTLSLAIQNKMTIEDLAYVDFFFQPHFDRPWNYLNILGLAALEQEGL

SEQ ID NO: 7 - protein, 463 aa, Clostridium bolteae ATCC BAA-613
MLVIRQDFKFQDSRRLLNMKETIVVIGANHGGTAVLNTILDQFPGNRVVAFDRNSDISFLGCGMALWIGGQISGPEGLFYSSKEAFEEKGAVIHMETEVERIDFDGKAVYARGKDGKSYVQEYDKLILATGSVPLRPEIEGMELDNVQFVKLYQNARDVIEKLKDTSVKKVAVVGAGYIGVELAEAFKRNGREVVLIDLADTCLSGYYDREFSDRMAHNLQEHGVKLAFGEKVVRLEGKRRVERVVTDQGCYEADMVVFGIGFRPNTSLGQGRLRTFGNGAFLVDRRQETSVPGVYAVGDCATVYNNAIQAADYIALATNAVRSGIIAAHNACGKVLESVGVQGSNGISIWGLHMLSTGISLARAKRMGYDAAAADYEDWQKAEFMENGNHKVKIRIVYDRKSRIILGAQMCSDYDVSMGIHMFSMAVEEQVTIDKLKLFDLFFLPHFNKPYNYVTMAALGAE

SEQ ID NO: 8 - protein, 459 aa, Clostridium scindens ATCC 35704
MGAAYCVHGGRYRKVSDRIIVIGANHAGTAALNTILDNYTDKDVTAFDANSNISFLGCGMALWIGRQISGPEGLFYSDKETLEGKGAKVFLETKVSRIDFEKKTVYAMDKEGEEIEANYDKLILATGSLPIQPKVKGMELKNVQFVKLYQNAADVIEKLEDPSIQKVTIIGAGYIGVELAEAFARNGRKTTLVDCADTCLSAYYDPEFCKIMEENLRENGVRTAFGEMVQEIQGQELVERVVTDKDSYDTDMAVFCIGFRPNTQYADGSLELFRNGAFLVDLHQQASRPEVYAIGDCATVFNNATQRKDYIALATNAVRSGIIAAHNACGTPLESAGVQGSNAICIWGLNMVSTGISLKKALELGYEAAAADYEDWQKAGFIESGNEKVRIRIVYDKKTRIVLGAQMCSKYDISMGIHMFSLAIQEQVTIDKLKLLDLFFLPHFNQPYNYITMAALKAE

SEQ ID NO: 9 - protein, 446 aa, Anaerostipes caccae DSM 14662
MPKKIIVIGANHAGTAALNTILDNYKDVDVTAFDANSNISFLGCGMALWIGGQISGPDGLFYSSKEILEGKGAKIYMETSVNSVDFDSKVVYTKDAAGKDCEYPYDKLILATGSTPVGPQLPGMSLENVQFVKLYQNAAEVIEKLGDTSIKKVAVVGAGYIGVELAEAFQRNGREVTLIDCADTCLSAYYDDMFCKRMEKQLSDHGIHLAFEEKVERLEGNEKVEKVVTDKHTYDADMVIFCVGFRPNTKLGNGQLKQFHNNGAYLTDLMQQTSRPDVYAVGDCATVYNNAIEDTDYIALATNAVRSGIIAAHNACGTELKSPGVQGSNGISIWGLNMVSTGLSLERAKKLGFDAAATDYEDWQKAGFMEKDNYKVVIRIVYDKKTRRILGAQLCSDYDISMAIHLFSMAIQEKVTIDKLKLFDLFFLPHFNQPYNYITMAALNAE

SEQ ID NO: 10 - protein, 448 aa, Bifidobacterium animalis subsp. lactis BB-12
MTTTVAVVGCTHAGVFAANSILREHPDWQVHVFERNETVSFLSCGIALWVGGHVSDPKKMFYSSPQALEQAGATVHMHTDVTDVDVAAKTLEFRDLQTGDTQTLPYDKLVVTTGSRPIVPPLPGIDSKRVQLCKNWDDAVQIKERAHDLKNVIVIGAGYIGAELAEQFSTRGTQVTLIDAADRVLANNFDRFITDQVEAKYREHGVTLALGEAVKAFRDNGDSITVVTTKGEYTAPYAVLAVGFRPNTDLVRGQVETLDNGAIVVDEFMRASVPDVFAAGDSATVLFNPTGKLDYIPLATNAVRQGELVGLNIEKPTRKYMGTQATSAVQLYDLSLAASGMTQTYANNHGLDIRSTELLEDYRPAFMLSTAPVSCMLTWDPQTRLVKGAQFCSTTDEVAGAANVVSVAIQAKFTIDMLANVDFLFQPNFDQPVYYVGAVAAKAAAEQR

SEQ ID NO: 11 - protein, 462 aa, Bifidobacterium bifidum
MTTVAIVGCTHAGTFAATSILKQHPDWTVHVFERNDSLSFLSCGIALWVGDHVSDPKRMFYSSPKALAEAGATMHMRHDVLDVDVAGKVLRARDMNTGEVGEYRYDKLVITTGSAPVVPPIDGLDEALESGRVLLCKNWDHAMAIKERAGSAKSAVVIGAGYIGAEIAEQFSEIGVKTTLVDALDRVLANNFDATITDDVEQAFDEHGVTLALGQKVTAFRPAAGSDGIEGSGVTVVTEKGEYTADVAILGAGFRPNTALFADQLRMLKNGAIVIDDYMRASLPDNTVLDDVFAAGDSATVRYNPTGADDYIPLATNAVRQGLLIGENIVAATKRYPGTQATSAVQLYDLAMSATGLTAGGAKRRGIAAKSTTITQDYRPDFMLTTTPVTTTLVWSPVTRRILGAQFLSKHDISQAANVVSVAIQAGFTIDQLAGADLFFQPNFSQPINFVGAVAIQAVAES

SEQ ID NO: 12 - protein, 103 aa, Bifidobacterium bifidum CAG:234
MTTVAIVGCTHAGTFAATSILKQHPDWTIHVFERNDSLSFLSCGIALWVGDHVSDPKRMFYSSPKALAEGPRRRPSPKPAPRCTCATTCSMWMSPARCCAPVT

SEQ ID NO: 13 - protein, 462 aa, Bifidobacterium bifidum PRL2010
MTTVAIVGCTHAGTFAATSILKQHPDWTVHVFERNDSLSFLSCGIALWVGDHVSDPKRMFYSSPKALAEAGATMHMRHDVLDVDVAGKVLRARDMNTGEVGEYRYDKLVITTGSAPVVLPIDGLDEALESGRVLLCKNWDHAMAIKERAGSAKSAVVIGAGYIGAEIAEQFSEIGVKTTLVDALDRVLANNFDATITDDVEQAFDEHGVTLALGQKVTAFRPAAGSDGIEGSGVTVVTEKGEYTADMAILGAGFRPNTALFADQLRMLKNGAIVIDDYMRASLPDNTVLDDVFAAGDSATVRYNPTGADDYIPLATNAVRQGLLIGENIVAATKRYPGTQATSAVQLYDLAMSATGLTAGGAKRRGIAAKSTTITQDYRPDFMLTTTPVTTTLVWSPVTRRILGAQFLSKHDISQAANVVSVAIQAGFTIDQLAGADLFFQPNFSQPINFVGAVAIQAVAES

SEQ ID NO: 14 - protein, 448 aa, Bifidobacterium breve
MTTVAVIGCTHAGTFAATSILAEHPDWTVHVFERNGTLSFLSCGIALWVGDHVSDPKKMFYSSPAALAEAGATMHMRTDVTDVDLDAKTLTYRSLEDGDAATEQTLAFDKLVVTTGSRPVIPPIPGIDSPHVLLCKNWDHAIAIKEKAKTAKSAVVIGSGYIGAEIAEQFSVTGVKTTLVDGLDRPLANNFDKTITDQVAAAFEEHGVTLALGQKVVEFHDNDDNTVTVVTEKGEYTAEMAILAVGFLPNTGLLKGKVDMLPNGAIVVDDYMQASVPDVYAAGDSATVFYNPTGQHDYIPLATNAVRQGLLVGRNIEAPTVKYLGTQATSAVQLYDLSLAASGLTRAGAERRGLTVHETSLTEDYRPDFMLTTTPVTSILTWDPETRKVKGGQFCSKADISGAANVISMAIQAGFTIDQLANVDFLFQPNFDKPVYYVGAVAMKAAAE

SEQ ID NO: 15 - protein, 448 aa, Bifidobacterium breve 12L; identical to SEQ ID NO: 14

SEQ ID NO: 16 - protein, 448 aa, Bifidobacterium breve 2L; identical to SEQ ID NO: 14

SEQ ID NO: 17 - protein, 448 aa, Bifidobacterium breve 31L; identical to SEQ ID NO: 14

SEQ ID NO: 18 - protein, 448 aa, Bifidobacterium breve 689b
MTTVAVIGCTHAGTFATTSILAEHPDWTVHVFERNGTLSFLSCGIALWVGDHVSDPKKMFYSSPAALAEAGATMHMRTDVTDVDLDAKTLTYRSLEDGDAATEQTLAFDKLVVTTGSRPVIPPIPGIDSPHVLLCKNWDHAIAIKEKAKTAKSAVVIGSGYIGAEIAEQFSVTGVKTTLVDGLDRPLANNFDKTITDQVAAAFEEHGVTLALGQKVVEFHDNDDNTVTVVTEKGEYTAEMAILAVGFLPNTGLLKGKVDMLPNGAIVVDDYMQASVPDVYAAGDSATVFYNPTGQHDYIPLATNAVRQGLLVGRNIEAPTVKYLGTQATSAVQLYDLSLAASGLTRAGAERRGLTVHETSLTEDYRPDFMLTTTPVTSILTWDPETRKVKGGQFCSKADISGAANVISMAIQAGFTIDQLANVDFLFQPNFDKPVYYVGAVAMKAAAE

SEQ ID NO: 19 - protein, 448 aa, Bifidobacterium breve JCM 7017
MTTVAVIGCTHAGTFAATSILAEHPDWTVHVFERNGTLSFLSCGIALWVGDHVSDPKKMFYSSPAALAEAGATMHMRTDVTDVNLDTKTITYRSLEDGDDAPEQTLAFDKLVVTTGSRPVIPPIPGIDSPHVLLCKNWDHAIAIKEKAKTAKSAVVIGSGYIGAEIAEQFSVTGVKTTLVDGLDRPLANNFDKTITDQVAAAFEEHGVTLALGQKVVEFHDNDDNTVTVVTEKGEYTAEMAILAVGFLPNTDLLKGKVDMLPNGAIVVDDYMQASVPDVYAAGDSATVFYNPTGQHDYIPLATNAVRQGLLVGRNIEAPTMKYLGTQATSAVQLYDLSLAASGLTRAGAERRGLTVHETSLTEDYRPDFMLTTTPVTSILTWDPETRKVKGGQFCSKADISGAANVISMAIQAGFTIDQLANVDFLFQPNFDKPVYYVGAVAMKAAAE

SEQ ID NO: 20 - protein, 448 aa, Bifidobacterium breve JCM 7019; identical to SEQ ID NO: 14

SEQ ID NO: 21 - protein, 448 aa, Bifidobacterium breve NCFB 2258
MTTVAVIGCTHAGTFAATSILAEHPDWTVHVFERNGTLSFLSCGIALWVGDHVSDPKKMFYSSPAALAEAGATMHMRTDVTDVNLDTKTITYRSLEDGDDAPEQTLAFDKLVVTTGSRPVIPPIPGIDSPHVLLCKNWDHAIAIKEKAKTAKSAVVIGSGYIGAEIAEQFSVTGVKTTLVDGLDRPLANNFDKTITDQVAAAFEEHGVTLALGQKVVEFHDNDDNTVTVVTEKGEYTAEMAILAVGFLPNTDLLKGKVDMLPNGAIVVDDYMQASVPDVYAAGDSATVFYNPTGQHDYIPLATNAVRQGLLVGRNIEAPTVKYLGTQATSAVQLYDLSLAASGLTRAGAERRGLTVHETSLTEDYRPDFMLTTTPVTSILTWDPETRKVKGGQFCSKADISGAANVISMAIQAGFTIDQLANVDFLFQPNFDKPVYYVGAVAMKAAAE

SEQ ID NO: 22 - protein, 448 aa, Bifidobacterium breve S27; identical to SEQ ID NO: 14

SEQ ID NO: 23 - protein, 448 aa, Bifidobacterium breve UCC2003; identical to SEQ ID NO: 14

SEQ ID NO: 24 - protein, 453 aa, Enterococcus faecalis CBRD01
MKEGIYNMKVVVVGCTHAGTSAVKSILANHPEAEVTVYERNDNISFLSCGIALYVGGVVKNAADLFYSNPEELASLGATVKMEHNVEEINVDDKTVTAKNLQTGATETVSYDKLVMTTGSWPIIPPIPGIDAENILLCKNYSQANVIIEKAKDAKRVVVVGGGYIGIELVEAFVESGKQVTLVDGLDRILNKYLDKPFTDVLEKELVDRGVNLALGENVQQFVADEQGKVAKVITPSQEFEADMVIMCVGFRPNTELLKDKVDMLPNGAIEVNEYMQTSNPDIFAAGDSAVVHYNPSQTKNYIPLATNAVRQGMLVGRNLTEQKLAYRGTQGTSGLYLFGWKIGSTGVTKESAKLNGLDVEATVFEDNYRPEFMPTTEKVLMELVYEKGTQRIVGGQLMSKYDITQSANTLSLAVQNKMTVEDLAISDFFFQPHFDRPWNYLNLLAQAALENM

SEQ ID NO: 25 - protein, 446 aa, Lactococcus lactis subsp. cremoris UC509.9
MKIVVIGTNHAGIATANTLLEQYPGHEIVMIDRNSNMSYLGCGTAIWVGRQIEKPDELFYAKAEDFEAKGVKILTETEVSEIDFANKKVYAKTKSDDEIIEAYDKLVLATGSRPIIPNLPGKDLKGIHFLKLFQEGQAIDAEFTKEKVKRIAVIGAGYIGTEIAEAAKRRGKEVLLFDAENTSLASYYDEEFAKGMDENLAQHGIELHFGELAKEFKANEEGYVSQIVTNKATYDVDLVINCIGFTAYSALASDKLATFKNGAIKVDKHQQSSDPDVYAVGDVATIYSNALQDFTYIALASNAVRSGIVAGHNIGGKELESVGVQGSNGISIFGYNMTSTGLSVKAAKKLGLEVSFSDFEDKQKAWFLHENNDSVKIRIVYETNSRRIIGAQLASKSEIIAGNINMFSLAIQEKKTIDELALLDLFFLPHFNSPYNYMTVAALNAK

SEQ ID NO: 26 - protein, 446 aa, Lactococcus lactis subsp. lactis KF147
MKIVVIGTNHAGIATANTLIDQYPGHEIVMIDRNSNMSYLGCGTAIWVGRQIEKPDELFYAKAEDFEKKGVKILTETEVSEIDFTNKMIYAKSKTGEKITESYDKLVLATGSRPIIPNLPGKDLKGIHFLKLFQEGQAIDEEFAKNDVKRIAVIGAGYIGTEIAEAAKRRGKEVLLFDAESTSLASYYDEEFAKGMDENLAQHGIELHFGELAQEFKANEEGHVSQIVTNKSTYDVDLVINCIGFTANSALAGEHLETFKNGAIKVNKHQQSSDPDVYAVGDVATIYSNALQDFTYIALASNAVRSGIVAGHNIGGKSIESVGVQGSNGISIFGYNMTSTGLSVKAAKKIGLEVSFSDFEDKQKAWFLHENNDSVKIRIVYETKSRRIIGAQLASKSEIIAGNINMFSLAIQEKKTIDELALLDLFFLPHFNSPYNYMTVAALNAK

SEQ ID NO: 27 - protein, 305 aa, Oribacterium sinus
EFKKVCVLGGGYIGVELAEAFQRLGLEVTLIDMVDRILAGYFDAPFSDELKNRMEEHGIKLALGEKVEEFLGEGKVSGVKTDKGVYDADMVICAVGFRPNASLGADHLKLYQNGAYLVNRKQQTSDPSVYAIGDCASLYDNARGRENYIALATNAVRSGVVAGHNICGTPVESLGVQGSSALGIYGYKLACTGLSLAAAEREGMDVSYEDYEDTQFPAFMEVENPKVKIRIVYKKEDKKIVGCQLGSSYDATAIIHFFSLAIQKGLTMPELPLVDLFFMPHFNQPYNYVTRTGLNWLNKELGLKG

SEQ ID NO: 28 - protein, 436 aa, Streptococcus equi subsp. zooepidemicus MGCS10565
MLTNYGDANEIVVFDQNSNISFLGCGMALWIGEQISGPEGLFYSNKEELESLGAKVYMESPVQSIDYDAKTVTALVDGKEHVESYDKLIFATGSQPILPPIKGAEIKEGSLEFEATLENLQFVKLYQNSADVISKLENKDIKRVAVVGAGYIGVELAEAFQRKGKEVILIDVADTCLAGYYDRDLTDVMSKNLEEHGIQLAFGETVKEVAGDGKVEKLITDKNEYDVDMVILAVGFRPNTALGAGKIELFRNGAFLVNKHQETSIPGIYAIGDCATIYDNATRDTNYIALASNAVRTGIVAAHNACGTALEGIGVQGSNGISIYGLHMVSTGLTLEKAKCLGFDAAVTEYTDNQKPEFIEHGNFQVTIKIVYDKESRRILGAQMASHEDISMGIHMFSLAIQEGVTIEKLALTDIFFLPHFNKPYNYITMAALGAE

SEQ ID NO: 29 - protein, 455 aa, Streptococcus infantarius subsp. infantarius ATCC BAA-102
MSKIVVIGANHAGTACIKTMLTNYGSENEVVVFDQNSNISFLGCGMALWIGQQISGPEGLFYSNKEELEQLGARIYMNSPVESVDYDKKLVTALVDGKPHLESYDKLIFATGSRPIIPPIKGVELKEDSQEFEAKLENIQFVKLYQNAQDVIEKLKEKEISRVAVVGAGYIGVELAEAFQRKGKEVTLIDVADTCLAGYYDEDLSAIMANNLQAHGIKLAFGETVKEVVGKTKVEKIITDKASYNVDMVILAVGFRPNTSLAAGKVELFKNGAFLVDKKQETSLPGVYAIGDCATIYNNASCETDYIALASNAVRTGIVAAHNACGHNLEGIGVQGSNGISIYGLNMLSTGLTLEKAKIKGFDAEEVEYSDKQKPDFIEKNNFEVTLKIVYDKESRRVLGAQMLAMADISLGIHLFSLAIQEGVTIDKLALTDLFFLPHFNKPYNYITMAALNAE

SEQ ID NO: 30 - protein, 455 aa, Streptococcus macedonicus ACA-DC 198
MSKIVVIGANHAGTACIKTMLTNYGTENEVVVFDQNSNISFLGCGMALWIGEQIAGPEGLFYSDKDELEQLGAKVYMNSPVESIDYDKKEITALVDGQKHFETYDKLILATGSQPIIPPIKGVSMKEDSLEFESKLENVQFVKLYQNAEDVIERLKEKAISRVAVVGAGYIGVELAEAFQRKGKEVTLIDVAETCLAGYYDRDLSDAMANNLQEHGIHLAFGEAVQEIVGKTKVEKIITDKSEYDVDMVILAVGFRPNTALAQDKIKLFSNGAFLVDKYQETSMPDVYAIGDCATIYNNATQSTDYIALASNAVRTGIVAAHNACGHKLEGVGVQGSNGISIYGLNMVSTGLTLEKAKAKGFDALEVEYVDNQKPEFIQKDNFQVTLKIVYDKTSRVILGAQIMAKKDISMGIHLFSLAIQEQVTIDKLALTDLFFLPHFNKPYNYITMAALNAK

SEQ ID NO: 31 - protein, 459 aa, Streptococcus mitis
MSKIVVVGANHAGTACINTMLDNFGNENEIVVFDQNSNISFLGCGMALWIGEQIDGAEGLFYSDKEKLEAKGAKVYMNSPVLSIDYDNKVVTAEVEGKEHKESYEKLIFATGSTPILPPIEGVEIVKGNREFKATLENVQFVKLYQNAEEVIHKLSDKSQHLDRIAVVGGGYIGVELAEAFERLGKEVVLVDIVDTVLNGYYDKDFTQMMAKNLEDHNIRLALGQTVKAIEGDGKVERLITDKETFDVDMVILAVGFRPNTALADGKIELFRNGAFLVDKKQETSIPGVYAVGDCATVYDNARKDTSYIALASNAVRTGIVGAYNACGHELEGIGVQGSNGISIYGLHMVSTGLTLEKAKAAGYNATETGFNDLQKPEFMKHDNHEVAIKIVFDKDSREILGAQMVSRDSAISMGIHMFSLAIQEHVTIDKLALTDLFFLPHFNKPYNYITMAALTAEK

SEQ ID NO: 32 - protein, 459 aa, Streptococcus mitis SK321
MSKIVVVGANHAGTACINTMLDNFGNENEIVVFDQNSNISFLGCGMALWIGEQIDGAEGLFYSDKEKLEAKGAKVYMNSPVLSIDYDKKVVTAEVEGKEHKESYEKLIFATGSTPILPPIEGVEIVKGNREFKATLENVQFVKLYQNAEEVIHKLADKSQHLDRIAVVGGGYIGVELAEAFERLGKEVVLVDIVDTVLNGYYDKDFTQMMAKNLEDHNIRLALGQTVKAIEGDGKVERLITDKETFDVDMVILAVGFRPNTTLADGKIELFRNGAFLVNKKQETSLPGVFAVGDCATVYDNARKDTSYIALASNAVRTGIVGAYNACGHELEGIGVQGSNGISIYGLHMVSTGLTLEKAKAAGYNATETGFNDLQKPEFMKHDNHEVAIKIVFDKDSREILGAQMVSHDPAISMGIHMFSLAIQEHVTIDKLALTDLFFLPHFNKPYNYITMAALTAEK

SEQ ID NO: 33 - protein, 459 aa, Streptococcus mitis SK564
MSKIVVVGANHAGTACINTMLDNFGNENEIVVFDQNSNISFLGCGMALWIGEQIDGAEGLFYSDKEKLEAKGAKVYMNSPVLSIDYDNKVVTAEVEGKEHKESYEKLIFATGSTPILPPIEGVEIVKGNREFKATLENVQFVKLYQNAEEVINKLADKSKHLDRIAVVGGGYIGVELAEAFERLGKEVVLVDIVDTVLNGYYDKDFTKMMAKNLEDHNIRLALGQTVKAIEGDGKVERLITDKETFDVDMVILAVGFRPNTALADGKIELFRNGAFLVDKKQETSIPGVFAVGDCATVYDNARKETSYIALASNAVRTGIVGAYNACGHELEGIGVQGSNGISIYGLHMVSTGLTLEKAKAAGYNATETGFNDLQKPEFMKHDNHEVAIKIVFDKDSREILGAQMVSRDAAISMGIHMFSLAIQEHVTIDKLALTDLFFLPHFNKPYNYITMAALTAEK

SEQ ID NO: 34 - protein, 459 aa, Streptococcus mitis SK597
MSKIVVVGANHAGTACINTMLDNFGNENEIVVFDQNSNISFLGCGMALWIGEQIDGAEGLFYSDKEKLEAKGAKVYMNSPVLSIDYDNKVVTAEVEGKEHKESYEKLIFATGSTPILPPIDGVEIVKGNREFKATLENVQFVKLYQNAEEVIHKLSDKSQHLDRIAVVGGGYIGVELAEAFERLGKEVILVDIVDTVLNGYYDKDFTQMMAKNLEDHNIRLALGQTVKAIEGDGKVERLITDKETFDVDMVILAVGFRPNTALADGKIELFRNGAFLVDKKQETSLPGVFAVGDCATVYDNARKDTSYIALASNAVRTGIVGAYNACGHELEGIGVQGSNGISIYGLHMVSTGLTLEKAKAAGYNATETGFNDLQKPEFMKHDNHEVAIKIVFDKDSREILGAQMVSRDSAISMGIHMFSLAIQEHVTIDKLALTDLFFLPHFNKPYNYITMAALTAEK

SEQ ID NO: 35 - protein, 457 aa, Streptococcus mutans 11A1
MSKIVIVGANHAGTAAINTILDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSRDFEATLKNLQFVKLYQNAEDVINKLQDKTQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 36 - protein, 457 aa, Streptococcus mutans 11SSST2
MSKIVIVGANHAGTAAINTVLDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSCDFEATLKNLQFVKLYQNAEDVINKLQDKRQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMTKAALKAK

SEQ ID NO: 37 - protein, 457 aa, Streptococcus mutans 11VS1
MSKIVIVGANHAGTAAINTVLDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSRDFEATLKNLQFVKLYQNAEDVINKLQDKTQNLNRIAVVGAGYIGVELAEAFKRLGKEVILIDIVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 38 - protein, 457 aa, Streptococcus mutans 14D
MSKIVIVGANHAGTAAINTVLDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSRDFEATLKNLQFVKLYQNAEDVINKLQDKTQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 39 - protein, 457 aa, Streptococcus mutans 15JP3
MSKIVIVGANHAGTAAINTVLDNYGSENEVVVFDQNSNISFLGCGMALWIGKQISGPQGLFYADKESLEAKGAKIYMESPVTAIDYDAKRVTALVNSQEHVESYEKLILATGSTPILPPIKGAAIKEGSRDFEATLKNLQFVKLYQNAEDVINKLQDKTQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 40 - protein, 457 aa, Streptococcus mutans 15VF2; identical to SEQ ID NO: 38

SEQ ID NO: 41 - protein, 457 aa, Streptococcus mutans 1ID3
MSKIVIVGANHAGTAAINTILDNYGSENEVVVFDQNSNISFLGCGMALWIGKQISGPQGLFYADKESLEAKGAKIYMESPVIAIDYDAKRVTALVNGQEHVESYEKLILATGSTPILPPIKGAAIKEGSRDFEATLKNLQFVKLYQNAKDVINKLQDKSQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMTKAALKAK

SEQ ID NO: 42 - protein, 457 aa, Streptococcus mutans 1SM1
MSKIVIVGANHAGTAAINTILDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSRDFEATLKNLQFVKLYQNAEDVINKLQDKTQNLNRIAVVGAGYIGVELAEAFKRLGKEVILIDVVDTCLAGYYDQDLSEMMRQNLEDHGIELAFGETVKAIEGDGKVERIVTDKVSHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 43 - protein, 457 aa, Streptococcus mutans 21
MSKIVIVGANHAGTAAINTILDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSRDFEATLKNLQFVKLYQNAEDVINKLQDKSQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMTKAALKAK

SEQ ID NO: 44 - protein, 457 aa, Streptococcus mutans 24
MSKIVIVGANHAGTAAINTILDNYSSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSRDFEATLKNLQFVKLYQNAEDVINKLQDKTQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 45 - protein, 457 aa, Streptococcus mutans 2ST1; identical to SEQ ID NO: 43

SEQ ID NO: 46 - protein, 457 aa, Streptococcus mutans 2VS1; identical to SEQ ID NO: 38

SEQ ID NO: 47 - protein, 457 aa, Streptococcus mutans 3SN1
MSKIVIVGANHAGTAAINTILDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSRDFEATLKNLQFVKLYQNAEDVINKLQDKSQNLNRIAVVGAGYIGVELAEAFKRLGKEVILIDVVDTCLAGYYDQDLSEMMRQNLEDHGIELAFGETVKAIEGNGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 48 - protein, 457 aa, Streptococcus mutans 4SM1
MSKIVIVGANHAGTAAINTVLDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSRDFEATLKNLQFVKLYQNAEDVINKLQDKTQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNVKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 49 - protein, 457 aa, Streptococcus mutans 4VF1
MSKIVIVGANHAGTAAINTILDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSRDFEATLKNLQFVKLYQNAEDVINKLQDKSQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 50 - protein, 457 aa, Streptococcus mutans 5DC8
MSKIVIVGANHAGTAAINTVLDNYGSENEIVVFDQNSNISFLGCGMALWIGKQISGPQGLFYADKESLEAKGAKIYMESPVTAIDYDAKRVTALVNGQEHVESYEKLILATGSTPILPPIKGAAIKEGSCDFEATLKNLQFVKLYQNAEDVINKLQDKSQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 51 - protein, 457 aa, Streptococcus mutans 5SM3
MSKIVIVGANHAGTAAINTVLDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSCDFEATLKNLQFVKLYQNAEDVINKLQDKSQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 52 - protein, 457 aa, Streptococcus mutans 66-2A; identical to SEQ ID NO: 51

SEQ ID NO: 53 - protein, 457 aa, Streptococcus mutans 8ID3; identical to SEQ ID NO: 43

SEQ ID NO: 54 - protein, 457 aa, Streptococcus mutans A19; identical to SEQ ID NO: 49

SEQ ID NO: 55 - protein, 457 aa, Streptococcus mutans A9
MSKIVIVGANHAGTAAINTVLDNYGSENEIVVFDQNSNISFLGCGMALWIGKQISGPQGLFYADKESLEAKGAKIYMESPVTAIDYDAKRVTALVNGQEHVESYEKLILATGSTPILPPIKGAAIKEGSCDFEATLKNLQFVKLYQNAEDVINKLQDKSQNLNRIAVVGAGYIGVELAEAFKRLGKEVILIDVVDTCLAGYYDQDLSEMMRQNLEDHGIELAFGETVKAIEGDGKVERIITDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 56 - protein, 457 aa, Streptococcus mutans AC4446; identical to SEQ ID NO: 38

SEQ ID NO: 57 - protein, 457 aa, Streptococcus mutans ATCC 25175; identical to SEQ ID NO: 49

SEQ ID NO: 58 - protein, 457 aa, Streptococcus mutans B; identical to SEQ ID NO: 38

SEQ ID NO: 59 - protein, 457 aa, Streptococcus mutans G123; identical to SEQ ID NO: 38

SEQ ID NO: 60 - protein, 457 aa, Streptococcus mutans GS-5; identical to SEQ ID NO: 49

SEQ ID NO: 61 - protein, 457 aa, Streptococcus mutans KK21; identical to SEQ ID NO: 43

SEQ ID NO: 62 - protein, 457 aa, Streptococcus mutans KK23; identical to SEQ ID NO: 44

SEQ ID NO: 63 - protein, 457 aa, Streptococcus mutans LJ23; identical to SEQ ID NO: 43

SEQ ID NO: 64 - protein, 457 aa, Streptococcus mutans M21
MSKIVIVGANHAGTAAINTVLDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSCDFEATLKNLQFVKLYQNAEDVINKLQDKRQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 65 - protein, 457 aa, Streptococcus mutans M230; identical to SEQ ID NO: 38

SEQ ID NO: 66 - protein, 457 aa, Streptococcus mutans M2A; identical to SEQ ID NO: 38

SEQ ID NO: 67 - protein, 457 aa, Streptococcus mutans N29
MSKIVIVGANHAGTAAINTILDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSRDFEATLKNLQFVKLYQNAEDVINKLQDKSQNLNRIAVVGAGYIGVELAEAFKRLGKEVILIDVVDTCLAGYYDQDLSEMMRQNLEDHGIELAFGETVKAIEGNGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIEHLALLDYFFLPHFNQPYNYMTKAALKAK

SEQ ID NO: 68 - protein, 457 aa, Streptococcus mutans N3209; identical to SEQ ID NO: 43

SEQ ID NO: 69 - protein, 457 aa, Streptococcus mutans N34; identical to SEQ ID NO: 49

SEQ ID NO: 70 - protein, 457 aa, Streptococcus mutans N66; identical to SEQ ID NO: 43

SEQ ID NO: 71 - protein, 457 aa, Streptococcus mutans NCTC 11060; identical to SEQ ID NO: 49

SEQ ID NO: 72 - protein, 457 aa, Streptococcus mutans NFSM1
MSKIVIVGANHAGTAAINTILDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSRDFEATLKNLQFVKLYQNAEDVINKLQDKSQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATIYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 73 - protein, 457 aa, Streptococcus mutans NFSM2; identical to SEQ ID NO: 43

SEQ ID NO: 74 - protein, 457 aa, Streptococcus mutans NLML1; identical to SEQ ID NO: 49

SEQ ID NO: 75 - protein, 457 aa, Streptococcus mutans NLML4; identical to SEQ ID NO: 38

SEQ ID NO: 76 - protein, 457 aa, Streptococcus mutans NLML5
MSKIVIVGANHAGTAAINTILDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSRDFEATLKNLQFVKLYQNAEDVINKLQDKTQNLNRIAVVGAGYIGVELAEAFKRLGKEVILIDVVDTCLAGYYDLDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 77 - protein, 457 aa, Streptococcus mutans NLML8
MSKIVIVGANHAGTAAINTILDNYGSENEVVVFDQNSNISFLGCGMALWIGKQISGSQGLFYADKESLEAKGAKIYMESPVTAIDYDAKRVTALVNGQEHVESYEKLILATGSTPILPPIKGAAIKEGSCDFEATLKNLQFVKLYQNAEDVINKLQDKSQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 78 - protein, 457 aa, Streptococcus mutans NLML9; identical to SEQ ID NO: 49

SEQ ID NO: 79 - protein, 457 aa, Streptococcus mutans NMT4863
MSKIVIVGANHAGTAAINTILDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSRDFEATLKNLQFVKLYQNAEDVINKLQDKTQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMTKAALKAK

SEQ ID NO: 80 - protein, 457 aa, Streptococcus mutans NN2025; identical to SEQ ID NO: 38

SEQ ID NO: 81 - protein, 457 aa, Streptococcus mutans NV1996
MSKIVIVGANHAGTAAINTVLDNYGSENEVVVFDQNSNISFLGCGMALWIGKQISGPQGLFYADKESLEAKGAKIYMESPVTAIDYDAKRVTALINGQEHVESYEKLILATGSTPILPPIKGAAIKEGSRDFEATLKNLQFVKLYQNAEDVINKLQDKTQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 82 - protein, 457 aa, Streptococcus mutans NVAB; identical to SEQ ID NO: 49

SEQ ID NO: 83 - protein, 457 aa, Streptococcus mutans OMZ175
MSKIVIVGANHAGTAAINTILDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSCDFEATLKNLQFVKLYQNAEDVINKLQDKSQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMTKAALKAK

SEQ ID NO: 84 - protein, 457 aa, Streptococcus mutans PKUSS-HG01; identical to SEQ ID NO: 39

SEQ ID NO: 85 - protein, 457 aa, Streptococcus mutans PKUSS-LG01; identical to SEQ ID NO: 39

SEQ ID NO: 86 - protein, 457 aa, Streptococcus mutans R221; identical to SEQ ID NO: 38

SEQ ID NO: 87 - protein, 455 aa, Streptococcus mutans S1B
MSKIVIVGANHAGTAAINTVLDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSRDFEATLKNLQFVKLYQNAEDVINKLQDKSQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMTKAALK

SEQ ID NO: 88 - protein, 457 aa, Streptococcus mutans SA38; identical to SEQ ID NO: 48

SEQ ID NO: 89 - protein, 457 aa, Streptococcus mutans SA41; identical to SEQ ID NO: 39

SEQ ID NO: 90 - protein, 457 aa, Streptococcus mutans SF1; identical to SEQ ID NO: 38

SEQ ID NO: 91 - protein, 457 aa, Streptococcus mutans SF12; identical to SEQ ID NO: 49

SEQ ID NO: 92 - protein, 457 aa, Streptococcus mutans SF14
MSKIVIVGANHAGTAAINTVLDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSCDFEATLKNLQFVKLYQNAEDVINKLQDKSQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGYNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 93 - protein, 457 aa, Streptococcus mutans SM1; identical to SEQ ID NO: 50

SEQ ID NO: 94 - protein, 457 aa, Streptococcus mutans SM4; identical to SEQ ID NO: 38

SEQ ID NO: 95 - protein, 457 aa, Streptococcus mutans SM6; identical to SEQ ID NO: 51

SEQ ID NO: 96 - protein, 457 aa, Streptococcus mutans ST1
MSKIVIVGANHAGTAAINTILDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSCDFEATLKNLQFVKLYQNAEDVINKLQDKSQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 97 - protein, 457 aa, Streptococcus mutans ST6; identical to SEQ ID NO: 79

SEQ ID NO: 98 - protein, 457 aa, Streptococcus mutans T4
MSKIVIVGANHAGTAAINTILDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSRDFEATLKNLQFVKLYQNAEDVINKLQDKTQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNVKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 99 - protein, 457 aa, Streptococcus mutans U138; identical to SEQ ID NO: 49

SEQ ID NO: 100 - protein, 457 aa, Streptococcus mutans U2A; identical to SEQ ID NO: 96

SEQ ID NO: 101 - protein, 457 aa, Streptococcus mutans U2B; identical to SEQ ID NO: 43

SEQ ID NO: 102 - protein, 457 aa, Streptococcus mutans UA159; identical to SEQ ID NO: 43

SEQ ID NO: 103 - protein, 457 aa, Streptococcus mutans UA159-FR; identical to SEQ ID NO: 43

SEQ ID NO: 104 - protein, 457 aa, Streptococcus mutans W6
MSKIVIVGANHAGTAAINTVLDNYGSENEVVVFDQNSNISFLGCGMALWIGKQISGPQGLFYADKELLEAKGAKIYMESPVTAIDYDAKRVTALVNGQEHVESYEKLILATGSTPILPPIKGAAIKEGSRDFEATLKNLQFVKLYQNAEDVINKLQDKTQNLNRIAVVGAGYIGVELAEAFKRLGKEVILIDVVDTCLAGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 105 - protein, 459 aa, Streptococcus oralis
MSKIVVVGANHAGTACINTMLDNFGHENEIVVFDQNSNISFLGCGMALWIGEQIDGPEGLFYSDKEKLEAKGAKVYMNSPVLSIDYDNKVVTAEVEGKEHKESYDKLIFATGSTPILPPIEGVEIVKGNREFKATLENVQFVKLYQNAEEVIEKLEDKSKHLERIAVVGGGYIGVELAEAFERLGKEVVLVDIVDTVLNGYYDKDFTQMMAKNLEDHNIRLALGQTVKAIQGDGKVERLVTDKETFDVDMVVLAVGFRPNTALADGKIELFRNGAFLVDKKQETSIPGVYAVGDCATVYDNARKDTSYIALASNAVRTGIVGAYNACGHELEGIGVQGSNGISIYGLHMVSTGLTLEKAKAAGYNATETGFNDLQKPEFIKHDNHEVAIKIVFDKDSREILGAQMVSHDAAISMGIHMFSLAIQEHVTIDKLALTDLFFLPHFNKPYNYITMAALTAEK

SEQ ID NO: 106 - protein, 459 aa, Streptococcus oralis ATCC 35037
MSKIVVVGANHAGTACINTMLDNFGHENEIVVFDQNSNISFLGCGMALWIGEQIDGPEGLFYSDKEKLEAKGAKVYMNSPVLSIDYDNKVVTAEVEGKEHKESYDKLIFATGSTPILPPIEGVEIVKGNREFKATLENVQFVKLYQNAEEVIEKLEDKSKHLERIAVVGGGYIGVELAEAFERLGKEVVLVDIVDTVLNGYYDKDFTQMMAKNLEDHNIRLALGQTVKAIQGDGKVERLVTDKETFDVDMVVLAVGFRPNTALADGKIELFRNGAFLVDKKQETSIPGVYAVGDCATVYDNARKDTSYIALASNAVRTGIVGAYNACGHELEGIGVQGSNGISIYGLHMVSTGLTLEKAKAAGYNATETGFNDLQKPEFIKHDNHEVAIKIVFDKDSREILGAQMVSHDSAISMGIHMFSLAIQEHVTIDKLALTDLFFLPHFNKPYNYITMAALTAEK

SEQ ID NO: 107 - protein, 462 aa, Streptococcus pneumoniae 3063-00
MSKIVVVGANHAGTACINTMLDNFGNENEIVVFDQNSNISFLGCGMALWIGEQIDGAEGLFYSDKEKLEAKGAKVYMNSPVLSIDYDNKVVTAEVEGKEHKESYEKLIFATGSTPILPPIEGVEIVKGNREFKATLENVQFVKLYQNAEEVINKLSDKSQHLDRIAVVGGGYIGVELAEAFERLGKEVVLVDIVDTVLNGYYDKDFTQMMAKNLEDHNIRLALGQTVKAIEGDGKVERLITDKESFDVDMVILAVGFRPNTALADGKIELFRNGAFLVDKKQETSIPDVYAVGDCATVYDNARKDTSYIALASNAVRTGIVGAYNACGHELEGIGVQGSNGISIYGLHMVSTGLTLEKAKAAGYNATETGFNDLQKPEFMKHDNHEVAIKIVFDKDSREILGAQMVSHDIAISMGIHMFSLAIQEHVTIDKLALTDLFFLPHFNKPYNYITMAALTAENKNE

SEQ ID NO: 108 - protein, 459 aa, Streptococcus pneumoniae 4027-06
MSKIVVVGANHAGTACINTMLDNFGNENEIVVFDQNSNISFLGCGMALWIGEQIDGAEGLFYSDKEKLEAKGAKVYMNSPVLSIDYDNKVVTAEVEGKEHKESYEKLIFATGSTPILPPIEGVEIVKGNREFKATLENVQFVKLYQNAEEVINKLSDKSQHLDRIAVVGGGYIGVELAEAFERLGKEVVLVDIVDTVLNGYYDKDFTQMMAKNLEDHNIRLALGQTVKAIEGDGKVERLITDKESFDVDMVILAVGFRPNTALADGKIELFRNGAFLVDKKQETSIPGVYAVGDCATVYDNARKDTSYIALASNAVRTGIVGAYNACGHELEGIGVQGSNGISIYGLHMVSTGLTLEKAKAAGYNATETGFNDLQKPEFMKHDNHEVAIKIVFDKDSREILGAQMVSHDIAISMGIHMFSLAIQEHVTIDKLALTDLFFLPHFNKPYNYITMAALTAEK

SEQ ID NO: 109 - protein, 459 aa, Streptococcus pneumoniae 4075-00; identical to SEQ ID NO: 108

SEQ ID NO: 110 - protein, 459 aa, Streptococcus pneumoniae 5185-06; identical to SEQ ID NO: 108

SEQ ID NO: 111 - protein, 459 aa, Streptococcus pneumoniae 5652-06; identical to SEQ ID NO: 108

SEQ ID NO: 112 - protein, 459 aa, Streptococcus pneumoniae 5787-06; identical to SEQ ID NO: 108

SEQ ID NO: 113 - protein, 459 aa, Streptococcus pneumoniae 6735-05; identical to SEQ ID NO: 108

SEQ ID NO: 114 - protein, 459 aa, Streptococcus pneumoniae 6901-05; identical to SEQ ID NO: 108

SEQ ID NO: 115 - protein, 459 aa, Streptococcus pneumoniae 6963-05; identical to SEQ ID NO: 108

SEQ ID NO: 116 - protein, 459 aa, Streptococcus pneumoniae 7286-06; identical to SEQ ID NO: 108

SEQ ID NO: 117 - protein, 459 aa, Streptococcus pneumoniae 7533-05; identical to SEQ ID NO: 108

SEQ ID NO: 118 - protein, 388 aa, Streptococcus pneumoniae 7879-04
MSKIVVVGANHAGTACINTMLDNFGNENEIVVFDQNSNISFLGCGMALWIGEQIDGAEGLFYSDKEKLEAKGAKVYMNSPVLSIDYDNKVVTAEVEGKEHKESYEKLIFATGSTPILPPIEGVEIVKGNREFKATLENVQFVKLYQNAEEVINKLSDKSQHLDRIAVVGGGYIGVELAEAFERLGKEVVLVDIVDTVLNGYYDKDFTQMMAKNLEDHNIRLALGQTVKAIEGDGKVERLITDKESFDVDMVILAVGFRPNTALADGKIELFRNGAFLVDKKQETSIPGVYAVGDCATVYDNARKDTSYIALASNAVRTGIVGAYNACGHELEGIGVQGSNGISIYGLHMVSTGLTLEKAKAAGYNATETGFNDLQKPEFMKHDNHEVD

SEQ ID NO: 119 - protein, 459 aa, Streptococcus pneumoniae 8190-05; identical to SEQ ID NO: 108

SEQ ID NO: 120 - protein, 459 aa, Streptococcus pneumoniae ECC_3510
MSKIVVVGANHAGTACINTMLDNFGNENEIVVFDQNSNISFLGCGMALWIGEQIDGAEGLFYSDKDKLEAKGAKVYMNSPVLSIDYDNKVVTAEVEGKEHKESYEKLIFATGSTPILPPIEGVEIVKGNREFKATLENVQFVKLYQNAEEVINKLSDKSQHLDRIAVVGGGYIGVELAEAFERLGKEVVLVDIVDTVLNGYYDKDFTQMMAKNLEDHNIRLALGQTVKAIEGDGKVERLITDKESFDVDMVILAVGFRPNTALADGKIELFRNGAFLVDKKQETSIPGVYAVGDCATVYDNARKDTSYIALASNAVRTGIVGAYNACGHELEGIGVQGSNGISIYGLHMVSTGLTLEKAKAAGYNATETGFNDLQKPEFMKHDNHEVAIKIVFDKDSREILGAQMVSHDIAISMGIHMFSLAIQEHVTIDKLALTDLFFLPHFNKPYNYITMAALTAEK

SEQ ID NO: 121 - protein, 459 aa, Streptococcus pneumoniae England14-9; identical to SEQ ID NO: 108

SEQ ID NO: 122 - protein, 459 aa, Streptococcus pneumoniae EU-NP01
MSKIVVVGANHAGTACINTMLDNFGNENEIVVFDQNSNISFLGCGMALWIGEQIDGAEGLFYSDKEKLEAKGAKVYMNSPVLSIDYDNKVVTAEVEGKEHKESYEKLIFATGSTPILPPIEGVEIVKGNREFKATLENVQFVKLYQNAEEVINKLSDKSQHLDRIAVVGGGYIGVELAEAFERLGKEVVLVDIVDTVLNGYYDKDFTQMMAKNLEDHNIRLALGQTVKAIEGDGKVERLITDKESFDVDMVILAVGFRPNTALAGGKIELFRNGAFLVDKKQETSIPDVYAVGDCATVYDNARKDTSYIALASNAVRTGIVGAYNACGHELEGIGVQGSNGISIYGLHMVSTGLTLEKAKAAGYNATETGFNDLQKPEFMKHDNHEVAIKIVFDKDSREILGAQMVSHDIAISMGIHMFSLAIQEHVTIDKLALTDLFFLPHFNKPYNYITMAALTAEK

SEQ ID NO: 123 - protein, 459 aa, Streptococcus pneumoniae EU-NP02; identical to SEQ ID NO: 108

SEQ ID NO: 124 - protein, 459 aa, Streptococcus pneumoniae EU-NP03; identical to SEQ ID NO: 108

SEQ ID NO: 125 - protein, 459 aa, Streptococcus pneumoniae EU-NP04; identical to SEQ ID NO: 108

SEQ ID NO: 126 - protein, 459 aa, Streptococcus pneumoniae EU-NP05; identical to SEQ ID NO: 108

SEQ ID NO: 127 - protein, 459 aa, Streptococcus pneumoniae GA02254; identical to SEQ ID NO: 108

SEQ ID NO: 128 - protein, 459 aa, Streptococcus pneumoniae GA02270; identical to SEQ ID NO: 108

SEQ ID NO: 129 - protein, 459 aa, Streptococcus pneumoniae GA02506; identical to SEQ ID NO: 120

SEQ ID NO: 130 - protein, 459 aa, Streptococcus pneumoniae GA02714; identical to SEQ ID NO: 108

SEQ ID NO: 131 - protein, 459 aa, Streptococcus pneumoniae GA04175; identical to SEQ ID NO: 108

SEQ ID NO: 132 - protein, 459 aa, Streptococcus pneumoniae GA05248; identical to SEQ ID NO: 120

SEQ ID NO: 133 - protein, 459 aa, Streptococcus pneumoniae GA05578; identical to SEQ ID NO: 120

SEQ ID NO: 134 - protein, 459 aa, Streptococcus pneumoniae GA06083; identical to SEQ ID NO: 108

SEQ ID NO: 135 - protein, 459 aa, Streptococcus pneumoniae GA07228; identical to SEQ ID NO: 108

SEQ ID NO: 136 - protein, 459 aa, Streptococcus pneumoniae GA07643; identical to SEQ ID NO: 122

SEQ ID NO: 137 - protein, 459 aa, Streptococcus pneumoniae GA07914; identical to SEQ ID NO: 122

SEQ ID NO: 138 - protein, 459 aa, Streptococcus pneumoniae GA08780; identical to SEQ ID NO: 108

SEQ ID NO: 139 - protein, 459 aa, Streptococcus pneumoniae GA08825
MSKIVVVGANHAGTACINTMLDNFGNENEIVVFDQNSNISFLGCGMALWIGEQIDGAEGLFYSDKEKLEAKGAKVYMNSPVLSIDYDNKVVTAEVEGKEHKESYEKLIFATGSTPILPPIEGVEIVKGNREFKATLENVQFVKLYQNAEEVINKLSDKSQHLDRIAVVGGGYIGVELAEAFERLGKEVVLVDIVDTVLNGYYDKDFTQMMAKNLEDHNIRLALGQTVKAIEGDGKVERLITDKESFDVDMVILAVGFRPNTALADGKIELFRNGAFLVDKKQETSIPDVYAVGDCATVYDNARKDTSYIALASNAVRTGIVGAYNACGHELEGIGVQGSNGISIYGLHMVSTGLTLEKAKAAGYNATETGFNDLQKPEFMKHDNHEVAIKIVFDKDSREILGAQMVSHDIAISMGIHMFSLAIQEHVTIDKLALTDLFFLPHFNKPYNYITMAALTAEK

SEQ ID NO: 140 - protein, 459 aa, Streptococcus pneumoniae GA11304; identical to SEQ ID NO: 120

SEQ ID NO: 141 - protein, 459 aa, Streptococcus pneumoniae GA11426; identical to SEQ ID NO: 108

SEQ ID NO: 142 - protein, 459 aa, Streptococcus pneumoniae GA11856; identical to SEQ ID NO: 108

SEQ ID NO: 143 - protein, 459 aa, Streptococcus pneumoniae GA13224; identical to SEQ ID NO: 108

SEQ ID NO: 144 - protein, 459 aa, Streptococcus pneumoniae GA13338; identical to SEQ ID NO: 108

SEQ ID NO: 145 - protein, 459 aa, Streptococcus pneumoniae GA13430; identical to SEQ ID NO: 108

SEQ ID NO: 146 - protein, 459 aa, Streptococcus pneumoniae GA13499; identical to SEQ ID NO: 139

SEQ ID NO: 147 - protein, 459 aa, Streptococcus pneumoniae GA14688
MSKIVVVGANHAGTACINTMLDNFGNENEIVVFDQNSNISFLGCGMALWIGEQIDGAEGLFYSDKEKLEAKGAKVYMNSPVLSIDYDNKVVIAEVEGKEHKESYEKLIFATGSTPILPPIEGVEIVKGNREFKATLENVQFVKLYQNAEEVINKLSDKSQHLDRIAVVGGGYIGVELAEAFERLGKEVVLVDIVDTVLNGYYDKDFTQMMAKNLEDHNIRLALGQTVKAIEGDGKVERLITDKESFDVDMVILAVGFRPNTALADGKIELFRNGAFLVDKKQETSIPGVYAVGDCATVYDNARKDTSYIALASNAVRTGIVGAYNACGHELEGIGVQGSNGISIYGLHMVSTGLTLEKAKAAGYNATETGFNDLQKPEFMKHDNHEVAIKIVFDKDSREILGAQMVSHDIAISMGIHMFSLAIQEHVTIDKLALTDLFFLPHFNKPYNYITMAALTAEK

SEQ ID NO: 148 - protein, 459 aa, Streptococcus pneumoniae GA16531; identical to SEQ ID NO: 120

SEQ ID NO: 149 - protein, 459 aa, Streptococcus pneumoniae GA17301; identical to SEQ ID NO: 108

SEQ ID NO: 150 - protein, 459 aa, Streptococcus pneumoniae GA18068; identical to SEQ ID NO: 122

SEQ ID NO: 151 - protein, 459 aa, Streptococcus pneumoniae GA18523; identical to SEQ ID NO: 108

SEQ ID NO: 152 - protein, 459 aa, Streptococcus pneumoniae GA19101; identical to SEQ ID NO: 108

SEQ ID NO: 153 - protein, 459 aa, Streptococcus pneumoniae GA19690; identical to SEQ ID NO: 108

SEQ ID NO: 154 - protein, 459 aa, Streptococcus pneumoniae GA19923; identical to SEQ ID NO: 108

SEQ ID NO: 155 - protein, 459 aa, Streptococcus pneumoniae GA40183; identical to SEQ ID NO: 108

SEQ ID NO: 156 - protein, 459 aa, Streptococcus pneumoniae GA40410; identical to SEQ ID NO: 108

SEQ ID NO: 157 - protein, 459 aa, Streptococcus pneumoniae GA40563; identical to SEQ ID NO: 108

SEQ ID NO: 158 - protein, 459 aa, Streptococcus pneumoniae GA41410; identical to SEQ ID NO: 108

SEQ ID NO: 159 - protein, 459 aa, Streptococcus pneumoniae GA41538; identical to SEQ ID NO: 120

SEQ ID NO: 160 - protein, 459 aa, Streptococcus pneumoniae GA43257; identical to SEQ ID NO: 108

SEQ ID NO: 161 - protein, 459 aa, Streptococcus pneumoniae GA43264; identical to SEQ ID NO: 108

SEQ ID NO: 162 - protein, 459 aa, Streptococcus pneumoniae GA43265; identical to SEQ ID NO: 108

SEQ ID NO: 163 - protein, 459 aa, Streptococcus pneumoniae GA44128; identical to SEQ ID NO: 147

SEQ ID NO: 164 - protein, 459 aa, Streptococcus pneumoniae GA44194
MSKIVVVGANHAGTACINTMLDNFGNENEIVVFDQNSNISFLGCGMALWIGEQIDGAEGLFYSDKEKLEAKGAKVYMNSPVLSIDYDNKVVTAEVEGKEHKESYEKLIFATGSTPILPPIEGVEIVKGNREFKATLENVQFVKLYQNAEEVINKLSDKSQHLDRIAVVGGGYIGVELAEAFERLGKEVVLVDIVDTVLNGYYDKDFTQMMAKNLEDHNIRLALGQTVKAIEGDGKVERLITDKESFDVDMVILAVGFRPNTALADGKIELFRNGAFLVDKKQETSIPGVYAVGDCATVYDNARKDTSYIALASNAVRTGIVGAYNACGHELEGIGVQGSNGISIYGLHMVSTGLTLEKAKAAGYNATETGFNDLQKPEFMKYDNHEVAIKIVFDKDSREILGAQMVSHDIAISMGIHMFSLAIQEHVTIDKLALTDLFFLPHFNKPYNYITMAALTAEK

SEQ ID NO: 165 - protein, 459 aa, Streptococcus pneumoniae GA44288; identical to SEQ ID NO: 108

SEQ ID NO: 166 - protein, 459 aa, Streptococcus pneumoniae GA44378; identical to SEQ ID NO: 108

SEQ ID NO: 167 - protein, 459 aa, Streptococcus pneumoniae GA44386; identical to SEQ ID NO: 108

SEQ ID NO: 168 - protein, 459 aa, Streptococcus pneumoniae GA44452; identical to SEQ ID NO: 108

SEQ ID NO: 169 - protein, 459 aa, Streptococcus pneumoniae GA44500; identical to SEQ ID NO: 108

SEQ ID NO: 170 - protein, 459 aa, Streptococcus pneumoniae GA44511; identical to SEQ ID NO: 108

SEQ ID NO: 171 - protein, 459 aa, Streptococcus pneumoniae GA47033; identical to SEQ ID NO: 108

SEQ ID NO: 172 - protein, 459 aa, Streptococcus pneumoniae GA47179; identical to SEQ ID NO: 164

SEQ ID NO: 173 - protein, 459 aa, Streptococcus pneumoniae GA47210; identical to SEQ ID NO: 108

SEQ ID NO: 174 - protein, 459 aa, Streptococcus pneumoniae GA47281; identical to SEQ ID NO: 108

SEQ ID NO: 175 - protein, 459 aa, Streptococcus pneumoniae GA47360; identical to SEQ ID NO: 122

SEQ ID NO: 176 - protein, 459 aa, Streptococcus pneumoniae GA47373; identical to SEQ ID NO: 122

SEQ ID NO: 177 - protein, 459 aa, Streptococcus pneumoniae GA47388; identical to SEQ ID NO: 108

SEQ ID NO: 178 - protein, 459 aa, Streptococcus pneumoniae GA47439
MSKIVVVGANHAGTACINTMLDNFGNENEIVVFDQNSNISFLGCGMALWIGEQIDGAEGLFYSDKEKLEAKGAKVYMNSPVLSIDYDNKVVTAEVEGKEHKESYEKLIFATGSTPILPPIEGVEIVKGNREFKATLENVQFVKLYQNAEEVINKLSDKSQHLDRIAVVGGGYIGVELAEAFERLGKEVVLVDIVDTVLNGYYDKDFTQMMAKNLEDHNIRLALGQTVKAIEGDGKVERLITDKESFDVDMVILAVGFRPNTALADGKIELFRNGAFLVDKKQETSIPGVYAVGDCATVYDNARKDTNYIALASNAVRTGIVGAYNACGHELEGIGVQGSNGISIYGLHMVSTGLTLEKAKAAGYNATETGFNDLQKPEFMKHDNHEVAIKIVFDKDSREILGAQMVSHDIAISMGIHMFSLAIQEHVTIDKLALTDLFFLPHFNKPYNYITMAALTAEK

SEQ ID NO: 179 - protein, 459 aa, Streptococcus pneumoniae GA47461
MSKIVVVGANHAGTACINTMLDNFGNENEIVVFDQNSNISFLGCGMALWIGEQIDGAEGLFYSDKEKLEAKGAKVYMNSPVLSIDYDNKVVTAEVEGKEHKESYEKLIFATGSTPILPPIEGVEIVKGNREFKATLENVQFVKLYQNAEEVINKLSDKSQHLDRIAVVGGGYIGVELAEAFERLGKEVVLVDIVDTVLNGYYDKDFTQMMAKNLEDHNIRLALGQTVKAIEGDGKVERLITDKESFDVDMVILAVGFRPNTALAGGKIELFRNGAFLVDKKQETSIPDVYAVGDCATVYDNARKDTSYIALASNAVRTGIVGAYNACGHELEGIGVQGSNGISIYGLHMVSTGLTLEKAKAAGYNATETGFNDFQKPEFMKHDNHEVAIKIVFDKDSREILGAQMVSHDIAISMGIHMFSLAIQEHVTIDKLALTDLFFLPHFNKPYNYITMAALTAEK

SEQ ID NO: 180 - protein, 459 aa, Streptococcus pneumoniae GA47502; identical to SEQ ID NO: 179

SEQ ID NO: 181 - protein, 459 aa, Streptococcus pneumoniae GA47522; identical to SEQ ID NO: 108

SEQ ID NO: 182 - protein, 459 aa, Streptococcus pneumoniae GA47597; identical to SEQ ID NO: 108

SEQ ID NO: 183 - protein, 459 aa, Streptococcus pneumoniae GA47628; identical to SEQ ID NO: 139

SEQ ID NO: 184 - protein, 459 aa, Streptococcus pneumoniae GA47751; identical to SEQ ID NO: 108

SEQ ID NO: 185 - protein, 459 aa, Streptococcus pneumoniae GA47760; identical to SEQ ID NO: 122

SEQ ID NO: 186 - protein, 459 aa, Streptococcus pneumoniae GA47976; identical to SEQ ID NO: 108

SEQ ID NO: 187 - protein, 459 aa, Streptococcus pneumoniae GA49138; identical to SEQ ID NO: 108

SEQ ID NO: 188 - protein, 459 aa, Streptococcus pneumoniae GA49194; identical to SEQ ID NO: 108

SEQ ID NO: 189 - protein, 459 aa, Streptococcus pneumoniae GA49447; identical to SEQ ID NO: 108

SEQ ID NO: 190 - protein, 459 aa, Streptococcus pneumoniae GA49542; identical to SEQ ID NO: 108

SEQ ID NO: 191 - protein, 459 aa, Streptococcus pneumoniae GA52612; identical to SEQ ID NO: 108

SEQ ID NO: 192 - protein, 459 aa, Streptococcus pneumoniae GA54644; identical to SEQ ID NO: 108

SEQ ID NO: 193 - protein, 459 aa, Streptococcus pneumoniae NorthCarolina6A-23; identical to SEQ ID NO: 108

SEQ ID NO: 194 - protein, 459 aa, Streptococcus pneumoniae NP070; identical to SEQ ID NO: 108

SEQ ID NO: 195 - protein, 459 aa, Streptococcus pneumoniae NP112; identical to SEQ ID NO: 147

SEQ ID NO: 196 - protein, 459 aa, Streptococcus pneumoniae NP127; identical to SEQ ID NO: 120

SEQ ID NO: 197 - protein, 459 aa, Streptococcus pneumoniae NP141; identical to SEQ ID NO: 108

SEQ ID NO: 198 - protein, 459 aa, Streptococcus pneumoniae NP170
MSKIVVVGANHAGTACINTMLDNFGNENEIVVFDQNSNISFLGCGMALWIGEQIDGAEGLFYSDKDKLEAKGAKVYMNSPVLSIDYDNKVVTAEVEGKEHKESYEKLIFATGSTPILPPIEGVEIVKGNREFKATLENVQFVKLYQNAEEVINKLSDKSQHLNRIAVVGGGYIGVELAEAFERLGKEVVLVDIVDTVLNGYYDKDFTQMMAKNLEDHNIRLALGQTVKAIEGDGKVERLITDKESFDVDMVILAVGFRPNTALADGKIELFRNGAFLVDKKQETSIPGVYAVGDCATVYDNARKDTSYIALASNAVRTGIVGAYNACGHELEGIGVQGSNGISIYGLHMVSTGLTLEKAKAAGYNATETGFNDLQKPEFMKHDNHEVAIKIVFDKDSREILGAQMVSHDIAISMGIHMFSLAIQEHVTIDKLALTDLFFLPHFNKPYNYITMAALTAEK

SEQ ID NO: 199 - protein, 459 aa, Streptococcus pneumoniae SPAR27; identical to SEQ ID NO: 108

SEQ ID NO: 200 - protein, 459 aa, Streptococcus pneumoniae SPAR48; identical to SEQ ID NO: 108

SEQ ID NO: 201 - protein, 459 aa, Streptococcus pneumoniae SPAR55; identical to SEQ ID NO: 122

SEQ ID NO: 202 - protein, 459 aa, Streptococcus pneumoniae SPAR95; identical to SEQ ID NO: 108

SEQ ID NO: 203 - protein, 459 aa, Streptococcus pyogenes; identical to SEQ ID NO: 108

SEQ ID NO: 204 - protein, 456 aa, Streptococcus pyogenes A20
MSKIVVVGANHAGTACIKTMLTNYGDANEIVVFDQNSNISFLGCGMALWIGEQIAGPEGLFYSDKEELESLGAKVYMESPVQSIDYDAKTVTALVDGKNHVETYDKLIFATGSQPILPPIKGAEIKEGSLEFEATLENLQFVKLYQNSADVIAKLENKDIKRVAVVGAGYIGVELAEAFQRKGKEVVLIDVVDTCLAGYYDRDLTDLMAKNMEEHGIQLAFGETVKEVAGNGKVEKIITDKNEYDVDMVILAVGFRPNTTLGNGKIDLFRNGAFLVNKRQETSIPGVYAIGDCATIYDNATRDTNYIALASNAVRTGIVAAHNACGTDLEGIGVQGSNGISIYGLHMVSTGLTLEKAKRLGFDAAVTEYTDNQKPEFIEHGNFPVTIKIVYDKDSRRILGAQMAAREDVSMGIHMFSLAIQEGVTIEKLALTDIFFLPHFNKPYNYITMAALGAKD

SEQ ID NO: 205 - protein, 456 aa, Streptococcus pyogenes AA216; identical to SEQ ID NO: 204

SEQ ID NO: 206 - protein, 456 aa, Streptococcus pyogenes AA472
MSKIVVVGANHAGTACIKTMLTNYGDANEIVVFDQNSNISFLGCGMALWIGEQIAGPEGLFYSDKEELESLGAKVYMESPVQSIDYDAKTVTALVDGKNHVETYDKLIFATGSQPILPPIKGAEIKEGSLEFEATLENLQFVKLYQNSADVIAKLENKDIKRVAVVGAGYIGVELAEAFQRKGKEVVLIDVVDTCLAGYYDRDLTDLMAKNMEEHGIQLAFGETVKEVAGNGKVEKIITDKNEYDVDMVILAVGFRPNTTLGNGKIELFRNGAFLVNKRQETSIPGVYAIGDCATIYDNATRDTNYIALASNAVRTGIVAAHNACGTDLEGIGVQGSNGISIYGLHMVSTGLTLEKAKRLGFDAAVTEYTDNQKPEFIEHGNFPVTIKIVYDKDSRRILGAQMAAREDVSMGIHMFSLAIQEGVTIEKLALTDIFFLPHFNKPYNYITMAALGAKD

SEQ ID NO: 207 - protein, 456 aa, Streptococcus pyogenes Alab49
MSKIVVVGANHAGTACIKTMLTNYGDANEIVVFDQNSNISFLGCGMALWIGEQIAGPEGLFYSDKEELESLGAKVYMESPVQSIDYDAKTVTALVDGKNHVETYDKLIFATGSQPILPPIKGAEIKEGSLEFEATLENLQFVKLYQNSADVIAKLENKDIKRVAVVGAGYIGVELAEAFQRKGKEVVLIDVVDTCLAGYYDRDLTDLMAKNMEEHGIQLAFGETVKEVAGNGKVEKIITDKNEYDVDMVILAVGFRPNTTLGNGKIDLFRNGAFLVNKRQETSIPGVYAIGDCATIYDNATRDTNYIALASNAVRTGIVAAHNACGTDLEGIGVQGSNGISIYGLHMVSTGLTLEKAKRLGFDAAVTEYTDNQKPEFIEHGNFPVTIKIVYDKDSRRILGAQMAAREDMSMGIHMFSLAIQEGVTIEKLALTDIFFLPHFNKPYNYITMAALGAKD

SEQ ID NO: 208 - protein, 456 aa, Streptococcus pyogenes HKU QMH11M0907901
MSKIVVVGANHAGTACIKTMLTNYGDANEIVVFDQNSNISFLGCGMALWIGEQIAGPEGLFYSDKEELESLGAKVYMESPVQSIDYDAKTVTALVDGKNHVETYDKLIFATGSQPILPPIKGAEIKEGSLEFEATLENLQFVKLYQNSADVIAKLENKDIKRVAVVGAGYIGVELAEAFQRKGKEVVLIDVVDTCLAGYYDRDLTDLMAKNMEEHGIQLAFGETVKEVAGNGKVEKIITDKNEYDVDMVILAVGFRPNTTLGNGKIELFRNGAFLVNKRQETSIPGVYAIGDCATIYDNATRDTNYIALASNAVRTGIVAAHNACGTDLEGIGVQGSNGISIYGLHMVSTGLTLEKAKRLGFDAAVTEYTDNQKPEFIEHGNFPVTIKIVYDKDSRRILGAQMAAREDMSMGIHMFSLAIQEGVTIEKLALTDIFFLPHFNKPYNYITMAALGAKD

SEQ ID NO: 209 - protein, 456 aa, Streptococcus pyogenes JRS4; identical to SEQ ID NO: 204

SEQ ID NO: 210 - protein, 456 aa, Streptococcus pyogenes M1 476; identical to SEQ ID NO: 207

SEQ ID NO: 211 - protein, 456 aa, Streptococcus pyogenes M1 GAS; identical to SEQ ID NO: 204

SEQ ID NO: 212 - protein, 456 aa, Streptococcus pyogenes MGAS10270; identical to SEQ ID NO: 204

SEQ ID NO: 213 - protein, 456 aa, Streptococcus pyogenes MGAS10394
MSKIVVVGANHAGTACIKTMLTNYGDANEIVVFDQNSNISFLGCGMALWIGEQIAGPEGLFYSDKEELESLGAKVYMESPVQSIDYDAKTVTALVDGKNHVETYDKLIFATGSQPILPPIKGAEIKEGSLEFEATLQNLQFVKLYQNSADVIAKLENKDIKRVAVVGAGYIGVELAEAFQRKGKEVVLIDVVDTCLAGYYDRDLTDLMAKNMEEHGIQLAFGETVKEVAGNGKVEKIITDKNEYDVDMVILAVGFRPNTTLGNGKIDLFRNGAFLVNKRQETSIPGVYAIGDCATIYDNATRDTNYIALASNAVRTGIVAAHNACGTDLEGIGVQGSNGISIYGLHMVSTGLTLEKAKRLGFDAAVTEYTDNQKPEFIEHGNFLVTIKIVYDKDSRRILGAQMAAREDVSMGIHMFSLAIQEGVTIEKLALTDIFFLPHFNKPYNYITMAALGAKD

SEQ ID NO: 214 - protein, 456 aa, Streptococcus pyogenes MGAS10750; identical to SEQ ID NO: 213

SEQ ID NO: 215 - protein, 456 aa, Streptococcus pyogenes MGAS2096; identical to SEQ ID NO: 206

SEQ ID NO: 216 - protein, 456 aa, Streptococcus pyogenes MGAS2111
MSKIVVVGANHAGTACIKTMLTNYGDANEIVVFDQNSNISFLGCGMALWIGEQIAGPEGLFYSDKEELESLGAKVYMESPVQSIDYDAKTVTALVDGKNHVETYDKLIFATGSQPILPPIKGAEIKEGSLEFEATLENLQFVKLYQNSADVIAKLENKDIKRVAVVGAGYIGVELAEAFQRKGKEVVLIDVVDTCLAGYYDRDLTDLMAKNMEEHGIQLAFGETVKEVAGNGKVEKIITDKNEYDVDMVILAVGFRPNTTLGNGKIDLFRNGAFLVNKRQETSIPGVYAIGDCATIYDNATRDTNYIALASNAVRTGIVAAHNACGTDLEGIGVQGSNGISIYGLHMVSTGLTLEKAKRLGFDAAVTEYTDNQKPEFIEHGNFPVTIKIVYDKDSRRILGTQMAAREDMSMGIHMFSLAIQEGVTIEKLALTDIFFLPHFNKPYNYITMAALGAKD

SEQ ID NO: 217 - protein, 356 aa, Streptococcus pyogenes MGAS5005
METYDKLIFATGSQPILPPIKGAEIKEGSLEFEATLENLQFVKLYQNSADVIAKLENKDIKRVAVVGAGYIGVELAEAFQRKGKEVVLIDVVDTCLAGYYDRDLTDLMAKNMEEHGIQLAFGETVKEVAGNGKVEKIITDKNEYDVDMVILAVGFRPNTTLGNGKIDLFRNGAFLVNKRQETSIPGVYAIGDCATIYDNATRDTNYIALASNAVRTGIVAAHNACGTDLEGIGVQGSNGISIYGLHMVSTGLTLEKAKRLGFDAAVTEYTDNQKPEFIEHGNFPVTIKIVYDKDSRRILGAQMAAREDVSMGIHMFSLAIQEGVTIEKLALTDIFFLPHFNKPYNYITMAALGAKD

SEQ ID NO: 218 - protein, 456 aa, Streptococcus pyogenes MGAS6180
MSKIVVVGANHAGTACIKTMLTNYGDANEIVVFDQNSNISFLGCGMALWIGEQIAGPEGLFYSDKEELESLGAKVYMESPVQSIDYDTKTVTALVDGKNHVETYDKLIFATGSQPILPPIKGAEIKEGSLEFEATLENLQFVKLYQNSADVIAKLENKDIKRVAVVGAGYIGVELAEAFQRKGKEVVLIDVVDTCLAGYYDRDLTDLMAKNMEEHGIQLAFGETVKEVAGNGKVEKIITDKNEYDVDMVILAVGFRPNTTLGNGKIDLFRNGAFLVNKRQETSIPGVYAIGDCATIYDNATRDTNYIALASNAVRTGIVAAHNACGTDLEGIGVQGSNGISIYGLHMVSTGLTLEKAKRLGFDAAVTEYTDNQKPEFIEHGNFPVTIKIVYDKDSRRILGAQMAAREDMSMGIHMFSLAIQEGVTIEKLALTDIFFLPHFNKPYNYITMAALGAKD

SEQ ID NO: 219 - protein, 456 aa, Streptococcus pyogenes MGAS9429; identical to SEQ ID NO: 204

SEQ ID NO: 220 - protein, 456 aa, Streptococcus pyogenes SS1447; identical to SEQ ID NO: 208

SEQ ID NO: 221 - protein, 457 aa, Streptococcus ratti FA-1 = DSM 20564
MSKIVVVGANHAGTSSVNTILDNYGSENEVVVFDQNSNISFLGCGMALWIGKQISGPQGLFYADKELLESKGAKVYMESPVTAIDYDAKTVTALVNGQEHVENYDKLILATGSTPILPPIEGASIKEGSREFEATLENLQFVKLYQNAEDVINKLQDKSKNLNRVAVVGAGYIGVELAEAFKRLGKEVTLIDVVDTCLAGYYDRDLSDMMSQNLEDHGIQLAFGETVKAIEGDGKVERIVTDKASRDVDMVILAVGFRPNTALGAGKLETFRNGAFLVNKKQETSLPDVYAVGDCATVYDNAINDTNYIALASNALRSGIVAGHNAAGHELESLGVQGSNGISIFGLNMVSTGLTAEKAKRFGYNPEVTELTDSQKASFIEHDNYPVTLKIVYDKDSRLILGAQMASKEDMSMGIHMFSLAIQEKVTIDRLALLDFFFLPHFNQPYNYITKAALNAK

SEQ ID NO: 222 - protein, 461 aa, Streptococcus salivarius K12
MDKLMSKIVVVGANHAGTFSINTILDNYGDQNEVVVFDQNSNISFLGCGMALWIGNQISGSDGLFYANKEGLESKGAKVYMNSPVESIDFDGKTVTALVDGKEHVESYDKLILATGSQPILPPIEGAEIKEGSRTFEATLENLQFVKLFQNAQEVIDKLNDKSQDIKRVAVVGAGYIGVELAEAFQRHGKEVILIDVVDTCLAGYYDHDLTELMAKNMESHGIKLAFGETVKAVEGDTKVERIVTDKNAYDVDMVVLAVGFRPNTALGAGKLETFRNGAYLVNKKQETSIKDVYAVGDCATVYDNALEDVNYIALASNAVRSGIVGGHNAGGGDVESNGVQGSNGISIYGLNMVSTGLTEEKAKRFGFNPAVVESTDLQKAAFMEDENEDVTIKIVYDKDTRKVLGAQMVSRMDISMGIHMFSLAIQEGVTIDRLQLLDLFFLPHFNQPLSYIAKAAISAK

SEQ ID NO: 223 - protein, 459 aa, Streptococcus sinensis
MSKIVVVGANHAGTACINTMLDNFGHENEIVVFDQNSNISFLGCGMALWIGEQIDGPEGLFYSNKEKLEEKGARIYMNSPVLSIDYDNKVVTAEVEGQEHKESYDKLIFATGSTPILPPIEGVEIVEGNREFKTTLDNVQFVKLYQNAEEVINKLADKSNHLERIAVVGGGYIGVELAEAFERLGKEVVLVDIVDTVLNGYYDKDFTQLMAKNLEDHNIRLALGQTVKAIQGDGKVERLVTDKETFDVDMVVLAVGFRPNTALADGKIELFRNGAFLVDKKQETSIPGVYAVGDCATVYDNARKDTSYIALASNAVRTGIVGAYNACGHELEGIGVQGSNGISIYGLHMVSTGLTLEKAKAAGYNATETGFNDLQKPEFMKHDNHEVAIKIVFDKDSREILGAQMVSHDPAIGMGIHMFSLAIQEHVTIDKLALTDIFFLPHFNKPYNYITMAALTAEK

SEQ ID NO: 224 - protein, 48 aa, Streptococcus sp. HSISB1
MALWIGDQISGPEGLFYSSKEELEALGATIYMNSPVIAVDYDKKLLQP

SEQ ID NO: 225 - protein, 457 aa, Streptococcus sp. HSISS1
MSKIVVVGANHAGTFSINTILDNYGDQNEVVVFDQNSNISFLGCGMALWIGNQISGSDGLFYANKEGLESKGAKVYMNSPVESIDFDGKTVTALVDGKEHVESYDKLILATGSQPILPPIEGAEIKEGSRTFEATLDNLQFVKLFQNAQEVIDKLNDKSQDIKRVAVVGAGYIGVELAEAFQRHGKEVILIDVVDTCLAGYYDHDLTDLMAKNMESHGIKLAFGETVKAVEGETKVERIVTDKNAYDVDMVVLAVGFRPNTALGAGKLETFRNGAYLVNKKQETSIKDVYAVGDCATVYDNALDDVNYIALASNAVRSGIVGGHNAGGGDVESNGVQGSNGISIYGLNMVSTGLTEEKAKRFGFNPAVVSSTDLQKAAFMEDENADVTIKIVYDKDTRKVLGAQMVSRMDISMGIHMFSLAIQEGVTIDRLQLLDLFFLPHFNQPLSYIAKAAISAK

SEQ ID NO: 226 - protein, 457 aa, Streptococcus sp. HSISS4; identical to SEQ ID NO: 225

SEQ ID NO: 227 - protein, 457 aa, Streptococcus thermophilus
MSKIVVVGANHAGTYSINTILDNYGDQNEVVVFDQNSNISFLGCGMALWIGNQISGPNGLFYANKEGLESKGAKVYINSPVESIDFDGKTVTALVDGKEHVESYDKLILATGSQPILPPIDGAEIKEGSRTFEATLENLQFVKLFQNAQEVIDKLNDKSQDIKRVAVVGAGYIGVELAEAFQRRGKEVILIDVVDTCLAGYYDRDFTDRMAKNLEDHGIQLAFGETVKAVEGETKVERIVTDKNAYDVDMVVLAVGFRPNTALGAGKLETFRNGAYLVNKKQETSVKNVYAVGDCATVYDNALDDVNYIALASNAIRSGIVAGHNAGGGDVESNGVQGSNGISIYGLNMVSTGLTEEKAKRFGFNPAVVESTDLQKPPFMKDENEDVTIKIVYDKDTRKVLGAQMVSLMDISMGIHMFSLAIQEGVTIDRLQLLDLFFMPHFNQPLSYIAKAAISAE

SEQ ID NO: 228 - protein, 457 aa, Streptococcus thermophilus CAG:236
MSKIVVVGANHAGTYSINTILDNYGDQNEVVVFDQNSNISFLGCGMALWIGNQISGPDGLFYANKEGLESKGAKVYINSPVESIDFDGKTVTALVDGKEHVESYDKLILATGSQPILPPIDGAEIKEGSRTFEATLENLQFVKLFQNAQEVIDKLNDKSQDIKRVAVVGAGYIGVELAEAFQRHGKEVILIDVVDTCLAGYYDRDFTYRMAKNLEDHGIQLAFGETVKAVEGETKVERIVTDKNAYDVDMVVLAVGFRPNTALGAGKLETFRNGAYLVNKKQETSVKDVYAVGDCATVYDNALDDVNYIALASNAIRSGIVAGHNAGGGDVESNGVQGSNGISIYGLNMVSTGLTEEKAKRFGFNPAVVESTDLQKLPFMKDENEDVTIKIVYDKDTRKVLGAQMVSLMDISMGIHMFSLAIQEGVTIDRLQLLDLFFLPHFNQPLSYIAKAAISAE

SEQ ID NO: 229 - protein, 461 aa, Streptococcus thermophilus CNRZ1066
MDKFMSKIVVVGANHAGTYSINTILDNYGDQNEVVVFDQNSNISFLGCGMALWIGNQISGPDGLFYANKEGLESKGAKVYINSPVESIDFDGKTVTALVDGKEHVESYDKLILATGSQPILPPIDGAEIKEGSRTFEATLENLQFVKLFQNAQEVIDKLNDKSQDIKRVAVVGAGYIGVELAEAFQRHGKEVILIDVVDTCLAGYYDRDFTDRMAKNLEDHGIQLAFGETVKAVEGETKVERIVTDKNAYDVDMVVLAVGFRPNTALGAGKLETFRNGAYLVNKKQETSVKDVYAVGDCATVYDNALDDVNYIALASNAIRSGIVAGHNAGGGDVESNGVQGSNGISIYGLNMVSTGLTEEKAKRFGFNPAVVESTDLQKPPFMKDENEDVTIKIVYDKDTRKVLGAQMVSLMDISMGIHMFSLAIQEGVTIDRLQLLDLFFLPHFNQPLSYIAKAAISAE

SEQ ID NO: 230 - protein, 457 aa, Streptococcus thermophilus JIM 8232
MSKIVVVGANHAGTYSINTILDNYGDQNEVVVFDQNSNISFLGCGMALWIGNQISGPDGLFYANKEVLESKGAKVYINSPVESIDFDGKTVTALVDGKEHVESYDKLILATGSQPILPPIDGAEIKEGSRTFEATLENLQFVKLFQNAQEVIDKLNDKSQDIKRVAVVGAGYIGVELAEAFQRHGKEVILIDVVDTCLAGYYDRDFTDRMAKNLEDHGIQLAFGETVKAVEGETKVERIVTDKNAYDVDMVVLAVGFRPNTALGAGKLETFRNGAYLVNKKQETSVKDVYAVGDCATVYDNALDDVNYIALASNAIRSGIVAGHNAGGGDVESNGVQGSNGISIYGLNMVSTGLTEEKAKRFGFNPAVVESTDLQKPPFMKDENEDVTIKIVYDKDTRKVLGAQMVSLMDISMGIHMFSLAIQEGVTIDRLQLLDLFFLPHFNQPLSYIAKAAISAE

SEQ ID NO: 231 - protein, 461 aa, Streptococcus thermophilus LMG 18311; identical to SEQ ID NO: 229

SEQ ID NO: 232 - protein, 457 aa, Streptococcus thermophilus MN-ZLW-002; identical to SEQ ID NO: 230

SEQ ID NO: 233 - protein, 457 aa, Streptococcus thermophilus MTCC 5460; identical to SEQ ID NO: 227

SEQ ID NO: 234 - protein, 457 aa, Streptococcus thermophilus MTCC 5461; identical to SEQ ID NO: 227

SEQ ID NO: 235 - protein, 457 aa, Streptococcus thermophilus ND03; identical to SEQ ID NO: 230

SEQ ID NO: 236 - protein, 442 aa, Aeromonas hydrophila 4AK4
MRIVIIGGEAAGMSAAAKARRLAKDAEIVVYEASDVISFGACGLPYFVGDDFQEPGYMAEFTPEQFAAKGIEVKTGHRVLSLDATAQTLRVEHKGDSFTDSYDRLMIATGAREQMPPIPGLQQQGVFGLRRMSDGLALKGAVQDPRNKKAVVIGSGFIGLEVVEALVHQGKEVRLIELADRVIPDAFDSEITQHIETELREQGVSLHLGERVQALLGEGQVSGVRTDQGEYEADIVVLCTGVRPNTEFLADTGIERLGNGAIKVDRQGRTSLPNVWSAGDCASVWHSVKQQQVYVPLATIANKLGRMVGENLAGAKQMFPGTLGSAALKVLGLEAGRTGLSEKEAQQLGIDYSTVVIKDKCHTNYCPGQSDIHVKLVYEAGSKRLLGGQILGRKGAVHRIDALAVAITMGVTTDQLGMLDFAYAPPFSRTWDVLNVAGNVAK

SEQ ID NO: 237 - protein, 442 aa, Aeromonas media WS
MRIVIIGGEAAGMSAAAKARRLARDAEIVVYEASEVISFGACGLPYFVGDDFQEPGYMAEFTPEQFAAKGIEVKIGHRVLSVDATAQTLRVEHNGDSFTDRYDRLMIATGAREQMPPIPGLQQQGVFGLRRMSDGLALKTAVQDPCSKKAVVIGSGFIGLEVVEALVHQGKEVRLIELADRVIPDAFDSEITQHIETELREQGVCLHLGERVQALLGEGRVSGVRTDQGEYEADIVVVCTGVRPNTEFLADTGIARLGNGAIKVDRQGRSSLANVWAAGDCASVWHSVKKQQVYVPLATIANKLGRMVGENLAGAEQEFPGTLGSAALKVLGLEAGRTGLSEQEAKAMGIDYRTVVIKDKCHTNYCPGQSDIHVKLVYEAGSKRLLGGQILGRKGAVHRIDALAVAITMGVTTEQLGMLDFAYAPPFSRTWDVLNVAGNVAK

SEQ ID NO: 238 - protein, 442 aa, Aeromonas salmonicida subsp. salmonicida A449
MRILIIGGEAAGMSAAAKARRLAKDAEIVVYEASEVISFGACGLPYFVGDEFQEPGYMAEFTPEQFAAKGIEVKTGHRVLSLDASAGTVQVEHQGDVFTDTYDRLMVATGAREVMPPIPGLQQQGVFGLRRMADGLALKAAVQDKRNTRALVIGSGFIGLEVVEALVHQGKEVRLIELADRVIPDAFDSEITRHIETELREQGVCVHLGERVEALLGDGRVTGVRTDKGEYEADIVVVCTGVKPNTEFLADTGIKRLANGAIEVDRQGRTSLANVWSAGDCASVWHSVKQQQVYVPLATIANKLGRMVGENLAGAEQVFPGTLGSAALKVLGLEAGRTGLSEQEAQAMGIDYRTVVIKDKCHTNYCPGQSDIHVKLVYEAGSKRLLGGQILGRKGAVHRIDALAVAITMGVTTEQLGMLDFAYAPPFSRTWDVLNVAGNVAK

SEQ ID NO: 239 - protein, 442 aa, Aeromonas veronii B565
MRILIIGGEAAGMSAAAKARRLAKDADIVVYEASEVISFGACGLPYFVGDEFQDPGYMAEFTPEQFAAKGIEVKIGHRVLSVDATAQTLQVEHNGDTFTDSYDRLMIATGAREVMPPIPGLQQQGVFGLRRMADGLALKAAVQDKNNRRAVVIGSGFIGLEVVEALVHQGKEVRLIELADRVIPDAFDGEITQHIETELREQGVSLHLGERVEALLGDGRVTGVRTSQGEYEADIVVVCTGVKPNTEFLADTGIERLGNGAIKVDRQGRSSLANVWSAGDCASVWHSVKQQQVYVPLATIANKLGRMVGENLAGAEQTFPGTLGSAALKVLGLEAGRTGLSEQEAKAMGIDYRTVVIKDKCHTNYCPGQSDIHVKLVYEAGSKRLLGGQILGRKGAVHRIDALAVAITMGVTTEQLGMLDFAYAPPFSRTWDALNVAGNVAK

SEQ ID NO: 240 - protein, 432 aa, Bacillus cereus G9241
MSAAMQIVRNDENANVVTLEKGEIYSYAQCGLPYVISGAIASTEKLIARNVKTFRDKYGIDAKVRHEVTKVDTEKKIVYAEHTKTKDVFEFSYDRLLIATGVRPVMPEWEGRDLQGVHLLKTIPDAERILKTLETNKVEDVTIIGGGAIGLEMAETFVELGKKVRMIERNDHIGTIYDADMAEYIHKEADKHHIEILTNENVKAFKGNERVEAVETDKGTYKADFVLVSVGVQPNTDFLEGTNIRTNHKGAIEVNAYMQTNVQDVYAAGDCATHYHVIKEIHDHIPIGTTANKQGRLAGLNMLDKRRAFKGTLGTGIIKFMDLTLARTGLNEKEANGLHIPYKTVKVDSTNMAGYYPNAKPLYLKLLYRSDTKQLLGGQVIGEEGVDKRIDVIAMALFNKMSIHDLEDVDLSYAPPYNSVWDPIQQAARRAE

SEQ ID NO: 241 - protein, 443 aa, Borrelia afzelii PKo
MKIIIIGGTSAGTSAAAKAKRLNKSLDITIYEKTNIVSFGTCGLPYFIGGFFDNPNTMISRTQEEFEKTGISAKTNHEVIKVDTKSNTIVIKNQKTGSIFNNNYDKLMIATGAKPIIPAITNINLKNFYTLRNLEDGQNLKNLMDKEEIKNIVIIGAGYIGIEMIEAAKNKRKNVRLIQLDKHILTDSFDEEIVKIMEEELIEKGVELHTSEFVKSLIGEKRVEGVVTNKNTYQADVVILATGIKPDTEFLENQLKTTTNGAIIVNEYGETSIKNIFSAGDCATIYNIVSKKNEYIPLATTANKLGRVVGENLAGNHVPFKGTLGSASIKILSLEAARTGLTEKDAKKLQINYKTIFVKDKNHTNYYPGQEDLYVKLIYEENTKIILGAQAIGKNGAVIRIHALSIAIYSKLTTKELGMMDFSYSPPFSRTWDILNIAGNAAK

SEQ ID NO: 242 - protein, 443 aa, Borrelia crocidurae str. Achema
MKIIIIGGTAAGTSAAAKAKRINKELNIVIYEKTNTTSFGACGLPYFIGKFFDEPNNMIARTPEQFKQNGISVFPKHEVTKVDIKNNILQVKNLQTQEIFNDTYDKLMIATGGTPIIPPINNIKLKNFYTLRNMKDGKEIRELLNKQEIKNIIIIGAGYIGIEMVEATKAREKNVRIIQLDKRILTESFDKEITNIMEEELIKNNVLLHTNEFVTSLIGKDKVEGIITNKSEYKADLVILSTGIKPATEFLEGQLDTLKNGAIIVNEYGETSAKNIFAAGDCATIYNIISNQNDYIPLATTANKLGKIIGENLAGKRISFKGTLGSASIKVLSLEAARSGLTEEMALKLGIQYKTVFIKDKNHTNYYPNQEDLYIKLIYNQDTKEILGAQIIGKNGAALRMHALSLAIYSKLKINELGMMDFAYSPPFSKTWDALNIAGNAAK

SEQ ID NO: 243 - protein, 443 aa, Borrelia duttonii Ly
MKIIIIGGTAAGTSAAAKAKRINKELNIVIYEKTNTTSFGACGLPYFIGKFFDEPNNMIARTPEQFKQNGISVFPKHEVTKVDIKNNILQVKNLQTQEIFNDTYDKLMIATGGTPIIPPINNIKLKNFYTLRNMKDGKEIRELLNKQEIKNIIIIGAGYIGIEMVEATKAREKNVRIIQLDKRILTESFDKEITNIMEEELIKNNVLLHTNEFVTSLIGKDKVEGIITNKSEYKADLVILSTGIKPATEFLEGQLDTLKNGAIIVNEYGETSAKNIFAAGDCATIYNIISNQNDYIPLATTANKLGKIIGENLAGKRVSFKGTLGSASIKVLSLEAARSGLTEEMALKLGIQYKTVFIKDKNHTNYYPNQEDLYIKLIYNQDTKEILGAQIIGKNGAALRMHALSLAIYSKLKINELGMMDFAYSPPFSKTWDALNIAGNAAK

SEQ ID NO: 244 - protein, 443 aa, Borrelia garinii PBi
MKIIIIGGTSAGTSAAAKAKRLNKKLDITIYEKTNIVSFGTCGLPYFIGGFFDNPNKMISRTPEEFEKTGISVKTNHEVIKVNVKNNTIVIKNQITGSIFNNTYDKLMIATGAKPIIPAINNINLKNFYTLRNLEDGQKIKNLMDKEEIKNIVIIGAGYIGIEMIEAVKNKRKNVRLIQLDKHILIDSFDEEIVKIMEEELIQKGVDLHTSEFVKSLIGGKKVEGVVTNKNTYQADVVILATGIKPATEFLENQLKTSTNGAIIVNEYGETSIKNIFSAGDCATIYNIVSKKNEYIPLATTANKLGRIVGENLAGNHVSFKGTLGSASIKILSLEAARTGLTEKDAKKLQIKYKTIFIKDKNHTNYYPGQEDLYVKLIYEENTKIILGAQAIGKNGAVIRIHALSIAIYSKLTTKELGMMDFSYSPPFSRTWDILNIAGNAAK

SEQ ID NO: 245 - protein, 443 aa, Borrelia recurrentis A1
MKIIIIGGTAAGTSAAAKAKRINKELNIVIYEKTNTTSFGACGLPYFIGKFFDEPNNMIARTPEQFKQNGISVFPKHEVTKVDIKNNILQVKNLQTQEIFNDTYDKLMIATGGTPIIPPINNIKLKNFYTLRNMNDGKEIRELLNKQEIKNIIIIGAGYIGIEMVEATKARKKNVRIIQLDKRILTESFDKEITNIMEEELIKNNVLLHTNEFVTSLIGKDKVEGIITNKSKYKADLVILSTGIKPATEFLEGQLDTLKNGAIIVNEYGETSAKNIFAAGDCATIYNIISNQNDYIPLATTANKLGKIIGENLAGKRVSFKGTLGSASIKVLSLEAARSGLTEEMALKLGIQYKTVFIKDKNHTNYYPNQEDLYIKLIYNQDTKEILGAQIIGKNGAALRMHALSLAIYSKLKINELGMMDFAYSPPFSKTWDALNIAGNAAK

SEQ ID NO: 246 - protein, 462 aa, Intestinibacter bartlettii DSM 16795
MGEILSFGSSSKFKTDLGGNMRIIIVGGIAAGMSAAAKLRRTDRDAEIVVYEKSPHISFGACGLPYYVGGNFDNIDRMLVRTPEKVRETGIDVKVEHEVLSLDVQNKTIKVKDLQSGEIFSDKYDKLMIATGAATIIPPIENIETAYTLRSVEDGEKLKVKMQDESIKKVAVIGAGFIGLEVADVAKELGKEVCVFNMGSRILEKVLDEEVTEILEENLRAHGVELYFNTIVKSLETSPNKTKLITDTDEVEVDLVVLAAGVRPNTSFLKDTGIEMLQNGAIVIDDEGKTSIQDIYAAGDCATVYHLVKEEQVYIPLATNANKLGRIVGSNLGGKNEKFQGTLGSSCIKLLDMEAGATGITEEDAKNMNLNYKSVFIADKNHTDYCPGQEKIYVKLIYNADTKVILGGQVVGKSDAVQRTNVLATAIFAKMTTEQLGMLDLCYAPPFARTWDALNIAGNVSK

SEQ ID NO: 247 - protein, 452 aa, Lactobacillus Sanfranciscensis
  misc_feature (42)..(42): Xaa can be any naturally occurring amino acid
MKVIVVGCTHAGTFAVKQTIADHPDADVTAYEMNDNISFLSXGIALYLGKEIKNNDPRGLFYSSPEELSNLGANVQMRHQVTNVDPETKTIKVKDLITNEEKTEAYDKLIMTTGSKPTVPPIPGIDSSRVYLCKNYNDAKKLFEEAPKAKTITIIGSGYIGAELAEAYSNQNYNVNLIDGHERVLYKYFDKEFTDILAKDYEAHGVNLVLGSKVAAFEEVDDEIITKTLDGKEIKSDIAILCIGFRPNTELLKGKVAMLDNGAIITDEYMHSSNRDIFAAGDSAAVHYNPTNSNAYIPLATNAVRQGRLVGLNLTEDKVKDMGTQSSSGLKLYGRTYVSTGINTALAKANNLKVSEVIIADNYRPEFMLSTDEVLMSLVYDPKTRVILGGALSSMHDVSQSANVLSVCIQNKNTIDDLAMVDMLFQPQFDRPFNYLNILGQAAQAQADKAHK

SEQ ID NO: 248 - protein, 446 aa, Lactococcus lactis subsp. Cremoris
MKIVVIGTNHAGIATANTLLEQYPGHEIVMIDRNSNMSYLGCGTAIWVGRQIEKPDELFYAKAEDFEAKGVKILTETEVSEIDFANKKVYAKTKSDDEIIEAYDKLVLATGSRPIIPNLPGKDLKGIHFLKLFQEGQAIDAEFAKEKVKRIAVIGAGYIGTEIAEAAKRRGKEVLLFDAENTSLASYYDEEFAKGMDENLAQHGIELHFGELAKEFKANEEGYVSQIVTNKATYDVDLVINCIGFTANSALASDKLATFKNGAIKVDKHQQSSDPDVYAVGDVATIYSNALQDFTYIALASNAVRSGIVAGHNIGGKELESVGVQGSNGISIFGYNMTSTGLSVKAAKKLGLEVSFSDFEDKQKAWFLHENNDSVKIRIVYETKSRRIIGAQLASKSEIIAGNINMFSLAIQEKKTIDELALLDLFFLPHFNSPYNYMTVAALNAK

SEQ ID NO: 249 - protein, 446 aa, Lactococcus lactis subsp. cremoris MG1363; identical to SEQ ID NO: 248

SEQ ID NO: 250 - protein, 460 aa, Leptotrichia hofstadii F0254
MKGVYDFINYHAKNIMKIVVIGGGAAGMMFSTQYKKANPEDEIILFEKSSYVAWAGCPTPYFIADELKKSDVLHGTPEDFIKRGIDVKIHHEVTEINFENKTVTVKGNEINGIIFYDKLVIAVGAKSFVPNITGYSKDLENVFTLSHAEHAFKIKDYLNENKSKLKNAVVVGAGFIGLEMAESFRKNGLNVTLIEKADQIFPNVSENLKKRIYKEIENNDVELKLNSGVSEIISENNIAKSVKLDNGETVDFDIALFSIGITPNIDFLPKELKTDSGKIAVNDKFETNIKDVYAIGDCIFNKYYKTDRNLYAPFGDVANKHGMFLAKHLSGKDVSWKGLIRSFATSFYDVKLAQTGLSLKEALQLRYNADVVSMKAMYKNSGFEDSVPASAEIIYDKDRKIVLGGAMVGKEAVAQFVDQMAIVIALETPIEKFIEIDFAYSPTNASVWNPLLVTYRKVIK

SEQ ID NO: 251 - protein, 456 aa, Streptococcus agalactiae A909
MSKIVVVGTNHAGTAAIKTMLSNYGEANEIVTFDQNSNISFLGCGMALWIGEQIDGPEGLFYSDKEQLESMGAKVYMNSPVLNIDYDKKEVTALVDGKEHVESYEKLILATGSQPIIPPIKGVEIQEGSREFKATLENLQFVKLYQNSEEVIEKLAKPGINRVAVVGAGYIGVELAEAFQRIGKEVTLVDVADTCMGGYYDRDFTDMMSKNLEDHGIRLAFGQAVQAVEGDGKVERLVTDKETFDVDMVILAVGFRPNTELGAGKLDTFRNGAWVVDKKQETSVKDVYAIGDCATIWDNSRDDINYIALASNAVRTGIVAAHNACGTELEGAGVQGSNGISIYGLNMVSTGLTLEKAKQAGYNAVETGFNDLQKPEFIKHNNHEVAIKIVYDKDSRVILGCQMVSHEDVSMGIHMFSLAIQEKVTIEKLALTDIFFLPHFNKPYNYITMAALGAKD

SEQ ID NO: 252 - protein, 456 aa, Streptococcus agalactiae CF01173; identical to SEQ ID NO: 251

SEQ ID NO: 253 - protein, 456 aa, Streptococcus agalactiae FSL S3-026; identical to SEQ ID NO: 251

SEQ ID NO: 254 - protein, 456 aa, Streptococcus agalactiae GB00112; identical to SEQ ID NO: 251

SEQ ID NO: 255 - protein, 456 aa, Streptococcus agalactiae SS1014; identical to SEQ ID NO: 251

SEQ ID NO: 256 - protein, 456 aa, Streptococcus agalactiae STIR-CD-17
MSKIVVVGTNHAGTAAIKTMLSNYGEANEIVTFDQNSNISFLGCGMALWIGEQIDGPEGLFYSDKEQLESMGAKVYMNSPVLNIDYDKKEVTALVDGKEHVESYEKLILATGSQPIIPPIKGVEIQEGSREFKATLENLQFVKLYQNSEEVIEKLAKPGINRVAVVGAGYIGVELAEAFQRIGKEVTLVDVADICMGGYYDRDFTDMMSKNLEDHGIRLAFGQAVQAVEGDGKVERLVTDKETFDVDMVILAVGFRPNTELGAGKLDTFRNGAWVVDKKQETSVKDVYAIGDCATIWDNSRDDINYIALASNAVRTGIVAAHNACGTELEGAGVQGSNGISIYGLNMVSTGLTLEKAKQAGYNAVETGFNDLQKPEFIKHNNHEVAIKIVYDKDSRVILGCQMVSHEDVSMGIHMFSLAIQEKVTIEKLALTDIFFLPHFNKPYNYITMAALGAKD

SEQ ID NO: 257 - protein, 456 aa, Streptococcus agalactiae ZQ0910; identical to SEQ ID NO: 251

SEQ ID NO: 258 - protein, 440 aa, Vibrio campbellii HY01
MKVVVVGGSAAGMSFAAKYKRNQPSDEVIVLDKRDYISFGACGLPYFAGGMFDDTERMISRTPEQAIKSGLDVRIETEMVALDRSEKQIKVRHQGDESTINYDMLVIATGARPIVPSFGEFNPEHVYTLTSMEDGLAVKEALKDSNKQRVCVIGGGFIGLEVFDAAHLLGKHVTIIEREQHVMSRQFSPEMIEVVEGAIRESGAELKTGCSVSAIRDAEQGGYIVETDNGNVEADVVIMSLGFKPNTEAFELPKAANGALLVDEFGATEDAHIYAAGDCAVVHHMALGKSVYVPLATTANKQARMMADKLAGKDTYMSGFLGSSCLKVLDYELACTGVSELLAKEHGLEVKVSTISDKNQTDYYPGQEDIKVKLVYHPETNVLLGGEIVGKKGAVGRINALAVAITAKMTTQQLGYMDFCYAPPFARTWDALNVAGNVAK

SEQ ID NO: 259 - protein, 448 aa, Clostridium aminovalericum NRIC0223; identical to SEQ ID NO: 6

SEQ ID NO: 260 - protein, 453 aa, Lactobacillus rhamnosus
MKILVIGATHAGTFATQQILTDHPDAEVTVYERNNNLSFLSCGIALWVGDHVSDPDKMFYSSPEALAKLGANMQMEHDVLNIDPATKTVEVKDLKTGTVTTDTYDKLVYTTGSTPIIPNIPGIHDSNVYLCKNWSDAKTLKDLAPSIKSAIVIGAGYIGAELAEQFALTDKEVTLIDGLPRVLAKNFDATITDRVEKLYTDHGVHLALNEMVTEFAQADQGIKVTTNKGDYTADIAILCTGFRPNTDLLKDHLDTLPNGAVITNAYMQTSDPDIFAAGDTATVHYNPTGKNDYIPLATNAVRQGILVGKNIMTPTEKYLGTQSSSAVELFDHAIAASGLTVEGAHTRGLELDSVTIEQDYRPDFMLTTTPVLCSLTWDPKTHEVKGGAFFSKHDISQSANVISLAIQTHMTIETLAMVDMLFQPNFDQPINWVNAVAMAAVDKAKKKPTTPVA

SEQ ID NO: 261 - protein, 453 aa, Lactobacillus rhamnosus ATCC 53103; identical to SEQ ID NO: 260

SEQ ID NO: 262 - protein, 446 aa, Lactococcus lactis MG1363; identical to SEQ ID NO: 248

SEQ ID NO: 263 - protein, 456 aa, Streptococcus agalactiae; identical to SEQ ID NO: 251

SEQ ID NO: 264 - protein, 457 aa, Streptococcus mutans NCBI 11723; identical to SEQ ID NO: 43

SEQ ID NO: 265 - protein, 446 aa, Enterococcus faecalis
MKVVVVGCTHAGTSAVKSILANHPEAEVTVYERNDNISFLSCGIALYVGGVVKNAADLFYSNPEELASLGATVKMEHNVEEINVDDKTVTAKNLQTGATETVSYDKLVMTTGSWPIIPPIPGIDAENILLCKNYSQANVIIEKAKDAKRVVVVGGGYIGIELVEAFVESGKQVTLVDGLDRILNKYLDKPFTDVLEKELVDRGVNLALGENVQQFVADEQGKVAKVITPSQEFEADMVIMCVGFRPNTELLKDKVDMLPNGAIEVNEYMQTSNPDIFAAGDSAVVHYNPSQTKNYIPLATNAVRQGMLVGRNLTEQKLAYRGTQGTSGLYLFGWKIGSTGVTKESAKLNGLDVEATVFEDNYRPEFMPTTEKVLMELVYEKGTQRIVGGQLMSKYDITQSANTLSLAVQNKMTVEDLAISDFFFQPHFDRPWNYLNLLAQAALENM

SEQ ID NO: 266 - protein, 484 aa, Giardia lamblia ATCC 50803
MQNVKLTLQDINLINLTFGDQKQRRAMKVIILGCNHGGTAVAKTIKQHDPSIEVSIYERNDNLSFLSCGIALGVHGTVKDMESLFYSNPDDLAGLGCVCHMQYNVTDIDFTTKKLTAVSLVTNETVTERYDKIVFATGSWPIIPDIPGIKSDKVLLCKNYMHAKKIVETFSHEENTKHCVVIGAGYIGVELAEAFGLKNQPCTLIDGSGRIMSRNFDKEFTDICEDEMRAHGVQLQMGERLEAFDEDDGKIVVRTSKGVYSGDAAILCIGFRPVTEMILESAERHGVKLDVHHPSKAIIIDECARTSLPGVYAIGDCATIHYTVTDEDRYMPLATNAIRTGLAAAAHILKLKHLRLIGTEGTSGIRIFKHHMASTGLTEEGALLAGIKNVKSVIINDTDRPGFMPTNANVMVKLVYDGDTHRVLGGQMMSEASVNQVMNALAVCIQNRYTIEKMAVQDFFFQPHYNNPWNTLNVAAISAINKKD

SEQ ID NO: 267 - protein, 458 aa, Giardia lamblia P15
MKVIILGCNHGGTAVAKTIKQHDPSIEVSIYERNDNLSFLSCGIALGVHGTVKDMESLFYSNPDDLAGLGCVCHMQYNVTDIDFTTKKLTAVSLVTNETVTEKYDKIVFATGSWPIIPDIPGIKSDKVLLCKNYMHAKKIVETFSHEENTKHCIVIGAGYIGVELAEAFGLKNQPCTLIDGSGRIMSRNFDKEFTDICEDEMRAHGVQLQMGERLEAFDEDDGKIIVRTSKGVYSGDAAVLCIGFRPVTEMILESAERHGVKLDVHHPSKAILIDECARTSLPGVYAIGDCATVHYTVTDEDRYMPLATNAIRTGLAAAAHILKLKHLRLIGTEGTSGIRIFKHHMASTGLTEEGALLAGIKNVKSIIVNDTDRPGFMPTNAKVMVKLVYDGDTHRVLGGQMMSEASVNQVMNALAVCIHNRYTIEKMAVQDFFFQPHYNNPWNTLNVAAISAINNKD

SEQ ID NO: 268 - protein, 458 aa, Giardia intestinalis ATCC 50581
MKVIILGCNHGGTAVAKTLKQHNPEIEVSIYERNDNLSFLSCGIALGVHGTVKDMESLFYSNPDDLSSLGCVCHMQHDVTDIDFTLKKLTAVNLVTNETVIESYDKIVFATGSWPVIPNIPGIKNEKVLLCKNYMHAKKIVETFSHEENTKHCIVIGAGYIGVELAEAFGLKGQPCTLIDGSARIMSRNFDKEFTDVCEEEMRAHGVQLQLGERLEAFDEDNGKIVVKTNHGAYTGDAAILCIGFRPVTEMILESARRHNVTLNVHEPSKAIIIDECARTNLPGVYAIGDCATIHYTVTDEDRYMPLATNAIRTGLAAAAHILKLKHLRLIGTEGTSGIRVFKHHMASTGLTEETAALSNIENVKTVVVTDTDRPGFMPTNANVIVKLVYDGTTHRILGGQMMSEASVNQIMNALAVCIQNRYTIEKMAVQDFFFQPHYNNPWNTLNVVAISAINSKN

SEQ ID NO: 269 - protein, 871 aa, Trichomonas vaginalis
MLKIQQLTEDIYWLGALDPTLAVFDIIMETKYGTTYNAYMIKTPAGAVLVETVKECFFEEYIEKVKSVIGDINNIKYLITNHTEPDHSGSIKKIIEIIPGLTVIGSKTALTYLEDIVNIPFRGHSAEDLKALKFGGKTFEFISCPFLHWPDSMYTWLPEEQALFTCDSFGAHYSPKKSILMSELPPEEEDGYQEALLYYYTAIFGPFKDFVIKGTDKILDLDIKIICLGHGPVLDARVQETIDTYRKWSEPALPHPGIEVVMVYASAYGYTTEMAEEIKNGILDKIPDASVKMYNVNIQNYGGMKADIMNSIATADGVLLGTNTINGDAVPPIWDVALSMNPIVHGGKIVTAFGSYGWSGEGVDNIINRFDKIRCKVVEPIKIKFRMSKKEHKQVREFGRRFADCLESGEVPDRAVPGRVVGAKDWSELNPTGAIVLWRCVICGEIYAGVTPPLVCPACGVGQDLFELYEAEEVTCSSFENLKFVVVGSGAAAVSAIDAIRARNTVASITMLTREKIMPYYRPIIVDALNSEISPENYYLKNEDWYTENNITVKLGTTVKSIDTARKSLTLSDGSTMQYDRLILATGSRPFVPPIGHEGLTGVYVIRTSNDVELLKETCKTAKKAVVIGGGVLGLENASAIKDRGLSVTVVECMPRLMARQLDPEASEILQGFVRDYGVDLRMGQCVVIKGDGKKVTGVQVGDEFISADFVVVNAGVRAESEVAAAAGIECSRGITVNNKMETSAQDVYAAGDCAYMENINQGLWAPALAMGKVAGANAAGDSKTFHFSIEPVNMIAMGTDLFAVGIPPDSPKGYNVISQRDEKEGTAIKLYFKDNRLVYAAGFKCQKQSGFLLKGVRNGHTLQHVLAELF

SEQ ID NO: 270 - protein, 871 aa, Trichomonas vaginalis
MLKIQQLTEDIYWLGVLDSNLAVFDIIMETKYGTTYNAYLIKTPEGAVLVETVKETFFDEYIEKVKSVIGDIHKIKYLITNHTEPDHSGSIKKMIELIPDLTVVGSKTALTYLEDIVNIPFKGHSAEDLKVLKFGGKSFEFISCPFLHWPDSMYTWVPEEKTLFTCDSFGAHYSPKKSILMSQLPPEEEEGYQDALLYYYTAIFGPFKEYVIKGTDKILNLDIKLVGLGHGPVLDARIKETIDTYRKWSAPLPTHEGKEVVMVYASAYGYTTEMAEEIKAGILAKIPDAKIKMFNVNIQNYGGLKGEIMNAIATADGVLLGTNTINGDAVPPVWDVALSMNPIVHGGKIVTAFGSYGWSGEGVDNIIARFDQIRCKVIDGCKIKFRMSKKEHGKVNEFGQQFGEALITGKVPERAVPGKVVGAKDWSELNPTGAVVLWRCVICGEIYAGVTPPLQCPACGVGQDLFELYEAEQVTHKSTEPLNYVIVGSGAAAVASIEAIRARNAVAKITMISREKVMPYYRPIIVDALNAEIAPDKYFLKNEEWYKENKIEIKLDTSVTAIDTKAKKVKLCRGDELAYDKLILATGSRPFIPPIGHEGLSGVIVIRTSADVDQLKAACQTAKKAVVIGGGVLGLENASAIKEKGVAVTVVECMPRLMARQLDTEASAVLLEEVKKFGVDVRLGMTVSIKGDGKHVTGVQVGEEFIPADFVVVNAGVRAESEVAAAAGIKCGRGIIVNNKMETNVPDVYAAGDCAFLDNMNQGLWAPALAMGKVAGANACGDNKTFAFAIEPVSMIAMGTDLFACGNPPESAQGYNVVSQKDDKEGSAIKLYFKDNRLVYAAGFRIQKISGSLLKGVREGRSLERIMAEIF

SEQ ID NO: 271 - protein, 871 aa, Trichomonas vaginalis
MLKIQQLTEDIYWLGVLDSDLAVFDIVMETKYGTTYNAYLIKTPEGAVLVETVKERFFDEYIDKVKTVIGDIKNIKYLITNHTEPDHSGSIKRMVELLPDVTVVGSKTALTYLEDIMNIPFKSQSAEDLKVLKFGGKTFEFISCPFLHWPDSMYTHLVEEKTLFTCDSFGAHYSPKKSILMSQLPPEEEEGYQDALLYYYTAIFGPFKEYVIKGTDKILNLDIKLICLGHGPVLDARIKETIDTYRKWSAPIPPHEGKEVVMVYASAYGYTTEMAEEIKTGIMEKCPDAKVKMFNVNIQNYGALKGEIMGAIATADGVLLGTNTINGDAVPPIWDVALSMNPIVHGGKVVSAFGSYGWSGEGVDNIIKRFDQIRCKVIDGMKIKFRMSKKEHEKVREFGNQFGNSLVTGVVPERAVPGKVVGAKDWSQLNPTGQIVLWRCVICGEIYAGVTPPAQCPACGVSEDLFELYEGEEIAVKSTEKLNFVVVGSGAAAVAACEAIRQRNSAASIQMITREKIMPYYRPIIVDALHGPIPDDQYWIKPEQWYKDNKIDVMLDTNVTSVDSKAKKVKLCCGKEVAYDKLILCTGSKPFVPPLGQEGLEGVLVIRTYLDVETLCKKCETAKSVVVIGGGVLGLENASNLEKKGLKVTVIECMPRLMSRQLDPEGSHFLEDAVRKYGINLKLGHAVGIKSDGKNVTGVQVGDEFVPADFIVINAGVRPECDVAKTGGVEIGRGISVNEKMETNIPDIYAAGDCAYLKNFNQGLWAPALAMGKVAGANAAGDDKTFSFAKEPVNMLAFNTDLFSIGCPPESEKGYNVIGQRDDKEGTLMRLYFQDNRLVYACCFKMQKISGALLKAAREGHSMQRVVAEVF

SEQ ID NO: 272 - protein, 573 aa, Synechocystis PCC6803
MFTTPLPPQKRLSTQTEAIAKNITAIRSLDWDRDRFDIEFGLQNGTTYNSYLIQADKVALVDSSHEKFRQLYLDLLQGLIDPQRIDYLIVSHTEPDHSGLVKDILQLNPRITVVATKVALQFLDNFVHQPFERIQVKSGDRLDLGQGHDLEFVSAPNLHWPDTMLTYDPATEILFTCDVFGMHYCSDAVFDIDLGKIAPDYQFYYDCLMGPNARSVLAAMKRMDNLGTISTVANGHGPLLRHNVGELLHRYRHWSESQSKAEKTVVVFYVADYGYGDRLSQAIAKGITKTGVGVDMVDLSSADPQEIQELVGHASGVVLGMPPLQANADLSTNFGAVLAAMQPKQVFGLYESYGGDDEPIDPLRTKFLDLGLREAFKVIKVKDTPSESTYQLCDESGTDLGQNLIQAAKIKQLKSLDSDLEKAIGRISGGLYIITAQKGEVKGAMLASWVSQASFNPPGFTVAVAKDRAIESLMQVGDRFVLNILEEGNYQILMKHFLKRFPPGADRFAGVKTQTASNGSPILTDALAYLECEVASRMECSDHWIVYSQVTNGRVAKAEGLTAVHHRKVGNYY

SEQ ID NO: 273 - protein, 578 aa, Synechocystis PCC6803
MVTLIDSPTSAAVQPRLTLQTADIAAHTTAIRCLDWDRDRFDIEFELRHGTTYNSFLIRGEKTALIDTSHRKFEAVYLQLLQDLVDLRSLDYLIVNHTEPDHSGLIPDLLELAPQVTVVGSKVAIQFLEKLVHRPFESQIVKSGHSLDLGQGHELQFISAPNLHWPDTILTYDSGTQVLYTCDVFGMHYCDDSLFDETPERLEPDFQYYYNCLMGSNARSVLMALKRIAPLQVVLVATGHGPLLQHHISHWLGQYDAWSQNQVKAETFVALFYVDGYGVSDRLVQTIADGISKTGVAIELVDLSVADTHEVRTLAQCAAGLVVGMPPQSSTSTTLDPLLGTILAAVHPKQVIGLFESGGGQDEPIYPLRNRFQELGLQEAFEPILLKTEPTAATDQLCREAGTDLGQYLTQKQSQQANTDLDPELNQAIGRLSTGLYILTAQKGDVRSAMLASWVIQGSFEPLGIVIAVAKDRAIESLLHPGDTFVLNVLEEDNYQSLMRHFLLRFPPGADRFAGVNTYPAQNGSPILLETLAYLECEVTSRLDGNDHWLVYSTIQTGRVAKLNALTATHHRKLGNHY

SEQ ID NO: 274 - protein, 441 aa, Salmonella enterica
MTQYQVLIIGFGKAGKTLAATLAKTGWRVAIIEQSASMFGGTCINIGCIPTKTLVHDAEREGDFSVAMQRKAAVVNFLRDKNFHNLADLDNVDVIEGRAEFIDNHTLRVFQADGERVLRGEKIFINTGAESVIPAITGLTTTAGVFDSTGLLSLSQRPARLGILGGGYIGLEFASMFANFGTKVTIFEAAPQFLPREDRDIAQAITRILQEKGVELILNANVQAVSSKEGAVQVETPEGAHLMDALLVASGRKPATAGLQLQNAGVAVNERGGIIVDDYLRTTADNIWAMGDVTGGLQFTYISLDDFRIVRDGLLGDGKRSTRDRQNVPYSVFMTPPLSRVGLTEEQARASGATVQVVTLPVAAIPRARVMNDTRGVLKAVVDVNTQRIVGVSLLCVDSHEMINIVKTVMDADLPYTVLRDQIFTHPTMSESLNDLFSLIK

SEQ ID NO: 275 - protein, 413 aa, Echinococcus multilocularis
MGMCSFFSITLLFTVWLSRASVLDLNTANFLDVLKAHEFVLVNFYAEWCRFSRDLAPIFMSTGESVAQEFKDGKVVLGRVDCDDQGALCMSQGVSKYPTLRLFKFTRRYGSEYRNQRSVEAFLTYLREQTADPVKKLNSAMDVGGLTTPRNMVGIFPSFTSDNAAYMNFYMASHLVGDCTFYGVADKNATASVIKFLLKKYPPTEDAKPQQLTLVKEEQATVETVTDFEALRSWAVERCTPLVRELTFANAEEITEPRLPLLILFYPPNNFTAAMRFGVLMEEHFSDLKGRFVPLVANGEVFSHPLLHMGKTMHDLPLMAIDSFQHMFLYPGNLDEALKDPKHINQFLADLASEKLHRQFHGFFEPPSEVPQKPPSEDKDRKAEEAKQSAPTSSVFKLLTPSSNRYSLLRDEL

SEQ ID NO: 276 - protein, 554 aa, Lactobacillus fermentum
MDQEHIYDLIIIGAGPAGLSAGIYAGRATLDTLILEADTVGGQVTTTSIVYNYPAAPAIDGTKLANQMQKQAADFGVTIKRDGVQEVQLDGEIKVITTKSGHQYQARSVVVATGAHPRKVGFKGEDEFRGRGVAYCSTCDGELFSGLQVFVVGGGYAAAEEADYLTRYAKHVTVLVRGDHFSCPPLTASRALDNPKVSVEYNTEIKEVSGDTYLTAMTLVNNQTGQEQTYQVEEGDKTFGVFVYVGTEPETNLFKGQLDLDSHGYILADEQCATNIAGVYAAGDVLAKELRQIITAASDGALAATNAEAYVTAEKKRLGIPVHVTPAKPAAKTVGQTSQVADQPAPQHTGDWFTPDLVEQLKAIFGRLTKDVTLQVLGDDSPLSQELTSFVDELAKLDSHLQVATAPVPADLDLAPQLRLLVDGLDTGLHFAGVPTGHEINSLILGIYNVAGPGQEIAPELVERIKALPATEIEIGVSLTCHFCPDVVAACQRMASLNPQVTATMIDLQHFPQLREERQIMSVPATMIDGGPVIFGSQTLEELVQAAEQATVKS

SEQ ID NO: 277 - protein, 700 aa, Dinoroseobacter shibae
MLKSLETQLLESRWDDEVAKGMSESELLLYRSNILGADKRVTNYGGGNTSAKVMEADPLTGAQVEVLWVKGSGGDIGSIKMDGFATLYMDKLRALKGLYRGVAFEDEMVSYLPHCTFRLNPRAASIDTPLHAYVPRKHVDHVHADAIIAIAASDNSKELTQEIFGNRIGWLPWKRPGFELGLWLEKFCRENPEADGVVLESHGLFTWADTAKECYDQTIDVINVATRWLAERSAGVPAFGGAIHESLPAAARREVAARLMPAIRGFVSDNQHMVGHFNDSDAVLEFVNARDMEALAALGTSCPDHFLRTKIRPLVVPFDPAQNNILAVLSELPDQVAAYREAYAAYYARCKHDDSPALRDPNAVVYLVPGVGMITFAKDKATARISGEFYVNAINVMRGASAVSTYQGLPEQEAFDIEYWLLEEAKLQRMPKPKSLAGRVALVTGGAGGIGAATAERFLAEGACVVLADINEDSLASTQERLSERFGADVVRSVVMNVTREEAVAAAFAEASVEFGGVDILVSNAGIASSAPIEETSLALWNKNMDILSTGYFLVSRAAFKLMRVQDMGGAVVFVASKNGLAASPNAAAYCTAKASEIHLARCLALEGAEAGIRVNVVNPDAVLRGSKIWEGDWLEQRAGTYGTDKDGLEEMYRQRSLLKRSVLPEDIAEACYFFAADASSKSTGNIINVDAGNVQAFTR

SEQ ID NO: 278 - protein, 8 aa, Bacterial
  MOD_RES (3)..(5): Xaa is Ala, Cys, Asp, Glu, Phe, Gly, His, Ile, Lys, Leu, Met, Asn, Pro, Gln, Arg, Ser, Thr, Val, Trp, Tyr, Asx, or Glx
  MOD_RES (6)..(6): Xaa  is Ala or Gly
  MOD_RES (7)..(7): Xaa is Ala, Cys, Asp, Glu, Phe, Gly, His, Ile, Lys, Leu, Met, Asn, Pro, Gln, Arg, Ser, Thr, Val, Trp, Tyr, Asx, or Glx
TGXXXXXG

SEQ ID NO: 279 - protein, 15 aa, Artificial Sequence
  Synthetic Construct
RQIKWFQNRRMKWKK

SEQ ID NO: 280 - protein, 11 aa, Artificial Sequence
  Synthetic Construct
YGRKKRRQRRR

SEQ ID NO: 281 - protein, 18 aa, Artificial Sequence
  Synthetic Construct
RGGRLSYSRRRFSTSTGR

SEQ ID NO: 282 - protein, 10 aa, Artificial Sequence
  Synthetic Construct
RRLSYSRRRF

SEQ ID NO: 283 - protein, 12 aa, Artificial Sequence
  Synthetic Construct
PIRRRKKLRRLK

SEQ ID NO: 284 - protein, 12 aa, Artificial Sequence
  Synthetic Construct
RRQRRTSKLMKR

SEQ ID NO: 285 - protein, 15 aa, Artificial Sequence
  Synthetic Construct
RRRRNRTRRNRRRVR

SEQ ID NO: 286 - protein, 19 aa, Artificial Sequence
  Synthetic Construct
KMTRAQRRAAARRNRWTAR

SEQ ID NO: 287 - protein, 13 aa, Artificial Sequence
  Synthetic Construct
TRRQRTRRARRNR

SEQ ID NO: 288 - protein, 13 aa, Artificial Sequence
  Synthetic Construct
GRKKRRQRRRPPQ

SEQ ID NO: 289 - protein, 13 aa, Artificial Sequence
  Synthetic Construct
GRRRRRRRRRPPQ

SEQ ID NO: 290 - protein, 27 aa, Artificial Sequence
  Synthetic Construct
GWTLNSAGYLLGKINLKALAALAKKIL

SEQ ID NO: 291 - protein, 17 aa, Artificial Sequence
  Synthetic Construct
KLALKLALKLALALKLA

SEQ ID NO: 292 - protein, 27 aa, Artificial Sequence
  Synthetic Construct
MGLGLHLLVLAAALQGAWSQPKKKRKV

SEQ ID NO: 293 - protein, 27 aa, Artificial Sequence
  Synthetic Construct
GALFLGWLGAAGSTMGAWSQPKKKRKV

SEQ ID NO: 294 - protein, 27 aa, Artificial Sequence
  Synthetic Construct
GALFLGFLGAAGSTMGAWSQPKKKRKV

SEQ ID NO: 295 - protein, 27 aa, Artificial Sequence
  Synthetic Construct
GALFLGFLGAAGSTMGAWSQPKSKRKV

SEQ ID NO: 296 - protein, 21 aa, Artificial Sequence
  Synthetic Construct
KETWWETWWTEWSQPKKKRKV

SEQ ID NO: 297 - protein, 21 aa, Artificial Sequence
  Synthetic Construct
KETWFETWFTEWSQPKKKRKV

SEQ ID NO: 298 - protein, 24 aa, Homo sapiens
MLATRVFSLVGKRAISTSVCVRAH

SEQ ID NO: 299 - protein, 30 aa, Artificial Sequence
  Synthetic Construct
MLRFTNCSCKTFVKSSYKLNIRRMNSSFRT

SEQ ID NO: 300 - protein, 19 aa, Artificial Sequence
  Synthetic Construct
MLSARSAIKRPIVRGLATV

SEQ ID NO: 301 - protein, 24 aa, Artificial Sequence
  Synthetic Construct
MLSARSAIKRPIVRGLATVSSFRT

SEQ ID NO: 302 - protein, 27 aa, Artificial Sequence
  Synthetic Construct
MLRSSVVRSRATLRPLLRRAYSSSFRT

SEQ ID NO: 303 - protein, 27 aa, Artificial Sequence
  Synthetic Construct
MLRFTNCSCKTFVKSSYKLNIRRMNTV

SEQ ID NO: 304 - protein, 19 aa, Artificial Sequence
  Synthetic Construct
MLSARSAIKRPIVRGLATV

SEQ ID NO: 305 - protein, 19 aa, Artificial Sequence
  Synthetic Construct
MLSRRSAIKRPIVRGLATV

SEQ ID NO: 306 - protein, 19 aa, Artificial Sequence
  Synthetic Construct
MLSASSAIKRPIVRGLATV

SEQ ID NO: 307 - protein, 19 aa, Artificial Sequence
  Synthetic Construct
MLSARSARKRPIVRGLATV

SEQ ID NO: 308 - protein, 19 aa, Artificial Sequence
  Synthetic Construct
MLSARSAICRPIVRGLATV

SEQ ID NO: 309 - protein, 19 aa, Artificial Sequence
  Synthetic Construct
MLSTAYAIKRPIVRGLATV

SEQ ID NO: 310 - protein, 19 aa, Artificial Sequence
  Synthetic Construct
MLSARSAIPIPIVRGLATV

SEQ ID NO: 311 - protein, 26 aa, Artificial Sequence
  Synthetic Construct
MLSARSAIKRPIVRGYKLNIRRMNTV

SEQ ID NO: 312 - protein, 26 aa, Artificial Sequence
  Synthetic Construct
MLSARSAIKRPIVRGKRPIVRGLATV

SEQ ID NO: 313 - protein, 25 aa, Artificial Sequence
  Synthetic Construct
MLSFTNCSCKTFVKSSYKLNIRRMN

SEQ ID NO: 314 - protein, 25 aa, Artificial Sequence
  Synthetic Construct
MLRFRNCSCKTFVKSSYKLNIRRMN

SEQ ID NO: 315 - protein, 25 aa, Artificial Sequence
  Synthetic Construct
MLRFTNCSKKTFVKSSYKLNIRRMN

SEQ ID NO: 316 - DNA, 1490 bp, Artificial Sequence
  Synthetic Construct
gcggccgcatgctcgctacaagggtctttagcctcgtcggaaagagagctatcagcacctccgtctgcgtgagagctcataaggtcaccgtggtcggatgcacccatgccggcaccttcgccatcaagcaaatcctcgctgagcaccctgacgccgaggtcaccgtctacgagaggaacgatgtgatctccttcctgtcctgtggcatcgccctctacctgggcggaaaagtggccgatccccaaggcctcttctacagctcccctgaagaactgcagaagctgggcgctaatgtgcagatgaaccacaacgtgctggccatcgaccctgaccaaaagaccgtcacagtcgaggacctcaccaatcacgcccagaccaccgagtcctacgacaaactggtgatgacctccggaagctggcctatcgtgcccaaaatccccggcatcgacagcgatagggtgaagctctgcaagaattgggcccacgcccaggctctgattgaggacgccaaggaggccaagaggatcaccgtcatcggcgccggatacatcggagccgaactggccgaggcctactccacaacaggccacgacgtcaccctgattgacgccatggctagggtcatgcccaagtacttcgatgccgacttcaccgacgtcatcgaacaggactacagggaccatggcgtgcaactcgctctgggcgagacagtggagagcttcaccgacagcgccaccggcctcacaatcaagacagacaagaactcctatgagaccgacctggccatcctctgcattggctttaggcccaacacagacctgctgaaaggcaaagtggacatggcccctaacggcgccatcattaccgacgactacatgaggtccagcaaccctgatattttcgctgctggcgactccgccgccgtccattacaaccccacacaccaaaacgcctacattcccctcgctaccaacgccgtcaggcagggaatcctcgtcggaaagaacctcgtcaagcccacagtgaagtacatgggaacccagtccagctccggactggccctctatgacaggacaattgtctccacaggcctcacactggccgccgccaagcaacaaggcctcaatgccgagcaggtcatcgtggaggacaactataggcccgagttcatgccttccaccgagcccgtcctcatgagcctggtcttcgaccccgatacacacagaatcctgggaggcgccctgatgtccaaatacgacgtgtcccagagcgctaataccctgtccgtctgcatccagaacgagaacaccatcgatgacctggccatggtggacatgctgttccagcccaatttcgacaggcccttcaactacctgaacattctcgcccaggctgcccaagctaaagtggcccaatccgtcaacgctggtggatctggtggatctggtggatctatggattacaaggatgacgatgacaagtaaacgcgt

SEQ ID NO: 317 - DNA, 1478 bp, Artificial Sequence
  Synthetic Construct
gcggccgcatgctggccaccagggtctttagcctggtgggcaaaagagccatctccacatccgtctgcgtgagagcccataagattgtcgtcatcggcaccaatcacgccggcattgctaccgccaacacactcctggagcagtaccccggccatgaaattgtcatgattgatagaaactccaatatgagctacctgggctgtggcaccgctatctgggtgggcaggcagatcgagaaacccgacgagctgttttacgccaaggccgaagactttgaggccaagggcgtgaagatcctcaccgagaccgaagtctccgagattgacttcgccaacaagaaggtctatgccaagaccaagagcgatgacgagatcatcgaggcctacgataaactcgtgctcgccacaggcagcagacctatcatccccaacctccccggaaaggacctgaagggaatccacttcctcaagctgttccaggaaggacaggccatcgacgccgagttcgccaaggagaaggtcaagaggattgctgtgatcggcgccggctatatcggcaccgagatcgccgaggccgctaaaaggaggggcaaggaagtcctgctgttcgacgccgaaaacacctccctggccagctactacgacgaagagtttgccaaaggcatggacgagaacctcgcccaacacggaattgaactccacttcggcgagctggccaaagagttcaaggccaacgaggagggctacgtgtcccagatcgtgaccaacaaggccacatacgatgtcgacctggtgatcaactgcatcggctttacagccaactccgctctggcctccgacaagctggccaccttcaagaacggcgccatcaaagtggacaagcaccagcagagctccgaccccgatgtctatgctgtgggcgacgtggccaccatctacagcaacgccctccaggacttcacatatatcgccctggccagcaacgctgtgagatccggcatcgtcgctggccataatatcggaggcaaggagctggagagcgtcggagtccagggcagcaacggcatctccatcttcggctataacatgaccagcacaggcctgtccgtgaaggccgccaagaaactcggcctggaagtgagcttcagcgactttgaggacaagcagaaggcctggttcctgcacgagaacaacgatagcgtgaagatcagaatcgtgtatgagacaaaaagcagaaggatcatcggcgcccagctggcctccaagtccgaaatcatcgctggcaacatcaacatgtttagcctggccatccaggagaagaaaaccatcgacgagctcgccctgctggatctcttcttcctgccccacttcaacagcccctacaactacatgaccgtggccgctctcaacgctaaaggtggatctggtggatctggtggatctatggattacaaggatgacgatgacaagtaaacgcgt

SEQ ID NO: 318 - DNA, 1517 bp, Artificial Sequence
  Synthetic Construct
gcggccgcatgctcgccaccagagtgttcagcctggtgggcaaaagggccatttccacctccgtgtgcgtgagagcccacagcaagatcgtggtggtgggcgctaaccacgctggcaccgcctgcatcaacaccatgctggacaatttcggcaacgagaacgagattgtcgtgttcgaccagaacagcaatatcagcttcctgggatgcggcatggccctgtggatcggcgagcaaatcgatggcgccgagggactgttctacagcgacaaggagaagctggaggccaagggcgccaaggtgtacatgaacagccccgtgctctccatcgactatgacaataaggtggtgaccgccgaggtcgagggcaaggagcataaggagagctacgagaagctgatctttgccacaggatccacccccatcctgcctcccatcgagggagtggagatcgtcaagggcaacagagagttcaaggccaccctggaaaacgtccaattcgtcaaactgtaccagaacgccgaggaagtgatcaacaagctgagcgacaagtcccagcacctggatagaatcgccgtggtcggaggcggctatatcggcgtggagctcgccgaagccttcgagaggctgggcaaggaggtggtgctggtggacatcgtggacaccgtgctgaatggatactacgacaaggacttcacccagatgatggccaagaacctggaggaccataacatcaggctcgctctgggccaaaccgtgaaggctatcgagggcgacggcaaggtcgagagactgattacagataaggaaagcttcgacgtggacatggtgattctggccgtgggctttaggcccaacaccgctctggccgacggcaagatcgaactcttcaggaacggcgccttcctggtggacaagaagcaggaaaccagcatccccggagtgtacgccgtcggcgattgcgctaccgtgtatgacaacgccaggaaagacaccagctacatcgctctggccagcaatgccgtgaggaccggcattgtcggcgcttacaacgcctgcggccacgagctggagggcattggagtccagggatccaatggaatcagcatctacggcctgcacatggtgtccaccggcctgacactggaaaaggccaaagccgctggctataatgccaccgagacaggcttcaatgatctccagaagcccgagttcatgaagcacgacaaccacgaagtcgccatcaagatcgtcttcgacaaggactccagagagatcctgggcgcccagatggtgagccacgacatcgccatctccatgggcatccacatgtttagcctggccatccaagagcacgtgacaatcgacaagctggccctgaccgacctgtttttcctgccccactttaacaagccctacaactacattaccatggctgccctgaccgccgagaagggtggatctggtggatctggtggatctatggattacaaggatgacgatgacaagtaaacgcgt

SEQ ID NO: 319 - DNA, 1511 bp, Artificial Sequence
  Synthetic Construct
gcggccgcatgctggccaccagagtgtttagcctggtcggaaagagggccatcagcaccagcgtctgcgtcagggcccatagcaagatcgtgatcgtcggagctaaccacgctggcaccgctgccatcaataccgtcctcgacaactacggcagcgagaacgaagtcgtggtgtttgaccagaactccaacatctccttcctcggctgtggaatggctctgtggattggcaagcagatcagcggcccccagggactcttctacgccgacaaggaatccctggaggctaagggcgccaaaatctatatggagtcccccgtcacagctattgactacgacgccaagagggtcacagccctggtgaacggccaagagcatgtggagagctacgaaaagctgatcctcgccaccggcagcacacctattctgccccccattaaaggcgccgctatcaaggagggctccagggacttcgaagctaccctgaagaacctgcagttcgtgaagctctaccagaacgccgaggacgtgatcaataagctgcaggacaagacccagaacctgaataggatcgccgtggtcggcgctggctacatcggagtcgagctggctgaggcctttaagagactgggcaaggaggtcatcctcatcgatgtcgtggacacatgcctggccggctactacgatcaggacctctccgagatgatgagacagaacctggaggaccacggcatcgagctcgccttcggcgaaaccgtgaaagccattgagggcgacggaaaggtcgagaggatcgtcaccgataaagctagccacgacgtggacatggtcatcctggctgtgggctttaggcccaacacagctctgggcaatgccaagctgaagacctttaggaacggcgccttcctcgtcgacaagaagcaggagacatccattcctgacgtgtacgccatcggcgactgcgccaccgtgtatgacaacgccatcaacgacaccaactatatcgccctggcttccaacgccctcagaagcggaattgtggccggccataatgccgctggccacaagctcgagtccctgggagtgcagggctccaacggaattagcatcttcggcctcaacatggtgtccacaggcctgacccaagagaaggccaaaagattcggctacaatcccgaggtgaccgcttttaccgactttcagaaggcctccttcatcgagcacgacaactatcctgtgaccctgaagatcgtctacgacaaggactccagactggtcctgggagctcagatggcctccaaggaggacatgtccatgggaatccacatgttttccctggccatccaggaaaaggtgaccatcgagagactcgccctcctcgactatttcttcctcccccatttcaaccaaccttataactacatgattaaggccgccctcaaggccaaaggtggatctggtggatctggtggatctatggattacaaggatgacgatgacaagtaaacgcgt

SEQ ID NO: 320 - DNA, 1496 bp, Artificial Sequence
  Synthetic Construct
gcggccgcatgctggccacaagagtgttctccctcgtcggcaaaagagccatcagcacaagcgtctgcgtgagggcccacaaagtgatcgtgatcggctgcaaccacgctggaacatgggccgctaaaaccctgaaggccacagaccccaactgtcaggtggtgacctacgacaggaacgacaacatctccttcctcgcctgtggaatcgctctgtgggtcggcggcgtggtgaaggaccctaaaggcctcttttatgccagccctgagtccctgaggggagagggaattgacgtctatatgggccacgacgtgaccaagatcgactgggccaacaagaagctctgcgtgaaggagctcaagaccggcaaggagttcgaggacacctatgacaagctgatcctggctacaggatcctggcccgtgacccctcccatcgaaggactgaagcaggagggcaccacctacggactgaagaagggaatcttctttagcaagctgtaccaacagggccaggagattatcgacgagatcgccaagcctgacgtgaagaaggtgatggtggtgggagccggatatatcggagtcgagctcatcgaggccttcaagaaccatggcaaggaggtgattctgatggaggccatgcctagggtgatggccaattacttcgacaaggagatcaccgacgaggccgaaaaaaggatcaaggaggccggcatcgagatgcatctgggcgagacagtgaagaagttcgaaggcgacgacagagtgaagaaggtcgtcaccgacaagggctcctatgacgtggacatggtcgtcatgagcgtcggcttcaggcctaacaacgagctgtataaagactatctggagaccctgcccaatggcgccatcgtcgtcgataccaccatgaagaccaccaaggatcccgacgtgttcgccattggagattgcgccaccgtgtatagcagggcctccgagaagcaagaatacatcgccctgagcaccaacgctgtgaggatgggcattgtggctgctaacaacgccctgggaaagcacgtcgagtactgtggcacccaaggctccaacgctatctgcgtcttcggctacaacatggcctccacaggctggagcgaagagacagccaagaagaagggactcaaggtgaagtccaacttcttcaaggacagcgagaggcctgagttcatgcccacaaatgaggacgtcctcgtcaagatcatctacgaagagggctccaggaggctgctgggagctcagattgccagcaagcacaaccacgccgaagctattcacgccttcagcctcgccatccagaacggaatgaccgtggatcagttcgccctgtccgacttcttcttcctgccccactacaataagcccctgtcctggatgacaatggtggcctacacagctaaaggtggatctggtggatctggtggatctatggattacaaggatgacgatgacaagtaaacgcgt

SEQ ID NO: 321 - DNA, 33 bp, Artificial Sequence
  Synthetic Construct
ttaattgcggccgcatgaaggtcaccgtggtcg

SEQ ID NO: 322 - DNA, 33 bp, Artificial Sequence
  Synthetic Construct
ttaattgcggccgcatgaagattgtcgtcatcg

SEQ ID NO: 323 - DNA, 33 bp, Artificial Sequence
  Synthetic Construct
ttaattgcggccgcatgagcaagatcgtggtgg

SEQ ID NO: 324 - DNA, 35 bp, Artificial Sequence
  Synthetic Construct
ttaattgcggccgcatgagcaagatcgtgatcgtc

SEQ ID NO: 325 - DNA, 33 bp, Artificial Sequence
  Synthetic Construct
ttaattgcggccgcatgaaagtgatcgtgatcg

SEQ ID NO: 326 - DNA, 35 bp, Artificial Sequence
  Synthetic Construct
ttaattacgcgtttacttgtcatcgtcatccttgt

SEQ ID NO: 327 - DNA, 32 bp, Artificial Sequence
  Synthetic Construct
ttaattggatccatgaaggtcaccgtggtcgg

SEQ ID NO: 328 - DNA, 31 bp, Artificial Sequence
  Synthetic Construct
ttaattctcgagtcacttgtcatcgtcatcc

SEQ ID NO: 329 - protein, 449 aa, Artificial Sequence
  Synthetic Construct
KVTVVGCTHAGTFAIKQILAEHPDAEVTVYERNDVISFLSCGIALYLGGKVADPQGLFYSSPEELQKLGANVQMNHNVLAIDPDQKTVTVEDLTNHAQTTESYDKLVMTSGSWPIVPKIPGIDSDRVKLCKNWAHAQALIEDAKEAKRITVIGAGYIAAELAEAYSTTGHDVTLIARSARVMRKYFDADFTDVIEQDYRDHGVQLALGETVESFTDSATGLTIKTDKNSYETDLAILCIGFRPNTDLLKGKVDMAPNGAIITDDYMRSSNPDIFAAGDSAAVHYNPTHQNAYIPLATNAVRQGILVGKNLVKPTVKYMGTQSSSGLALYDRTIVSTGLTLAAAKQQGLNAEQVIVEDNYRPEFMPSTEPVLMSLVFDPDTHRILGGALMSKYDVSQSANTLSVCIQNENTIDDLAMVDMLFQPNFDRPFNYLNILAQAAQAKVAQSVNA

SEQ ID NO: 330 - protein, 456 aa, Streptococcus mutans
SKIVIVGANHAGTAAINTVLDNYGSENEVVVFDQNSNISFLGCGMALWIGKQISGPQGLFYADKESLEAKGAKIYMESPVTAIDYDAKRVTALVNGQEHVESYEKLILATGSTPILPPIKGAAIKEGSRDFEATLKNLQFVKLYQNAEDVINKLQDKTQNLNRIAVVGAGYIGVELAEAFKRLGKEVILIARHDTCLRGYYDQDLSEMMRQNLEDHGIELAFGETVKAIEGDGKVERIVTDKASHDVDMVILAVGFRPNTALGNAKLKTFRNGAFLVDKKQETSIPDVYAIGDCATVYDNAINDTNYIALASNALRSGIVAGHNAAGHKLESLGVQGSNGISIFGLNMVSTGLTQEKAKRFGYNPEVTAFTDFQKASFIEHDNYPVTLKIVYDKDSRLVLGAQMASKEDMSMGIHMFSLAIQEKVTIERLALLDYFFLPHFNQPYNYMIKAALKAK

SEQ ID NO: 331 - protein, 8 aa, Artificial Sequence
  Synthetic Construct
ARSARVMR

The invention claimed is:

1. A mammalian cell comprising a nucleic acid encoding a water-forming NADH oxidase bound to a targeting peptide that localizes the water-forming NADH oxidase to mitochondria, wherein the water-forming NADH oxidase comprises an NADH-binding site comprising (i) a Rossmann fold domain having a dinucleotide-binding motif defined by the peptide G-x-G-x-x-G/A, wherein each x represents any amino acid, and (ii) a cofactor specificity loop, wherein the water-forming NADH oxidase is a bacterial water-forming NADH oxidase.

2. The mammalian cell of claim 1, wherein the targeting peptide comprises a mitochondrial targeting sequence from subunit IV of human cytochrome c oxidase.

3. The mammalian cell of claim 2, wherein the targeting peptide has the amino acid sequence of SEQ ID NO: 298.

4. The mammalian cell of claim 1, wherein the polypeptide exhibits Km values for NADH and O2 of no more than about 100 μM and 20 μM, respectively.

5. The mammalian cell of claim 1, wherein the polypeptide produces less than about 2% by mole of $H_2O_2$ compared to $H_2O$ production during the catalytic cycle of the polypeptide.

* * * * *

UNITED STATES PATENT AND TRADEMARK OFFICE
CERTIFICATE OF CORRECTION

PATENT NO. : 11,866,736 B2
APPLICATION NO. : 15/749218
DATED : January 9, 2024
INVENTOR(S) : Vamsi Mootha et al.

Page 1 of 1

It is certified that error appears in the above-identified patent and that said Letters Patent is hereby corrected as shown below:

In the Claims

Column 82, Claim 4, Line 20, replace "02" with --$O_2$--.

Signed and Sealed this
Fourteenth Day of May, 2024

Katherine Kelly Vidal
*Director of the United States Patent and Trademark Office*